United States Patent
West et al.

(10) Patent No.: US 10,669,339 B2
(45) Date of Patent: Jun. 2, 2020

(54) ANTI-PDL1 ANTIBODIES, ACTIVATABLE ANTI-PDL1 ANTIBODIES, AND METHODS OF USE THEREOF

(71) Applicant: CytomX Therapeutics, Inc., San Francisco, CA (US)

(72) Inventors: James William West, San Mateo, CA (US); Li Mei, San Francisco, CA (US); Stephen James Moore, Danville, CA (US); Margaret T. L. Nguyen, San Jose, CA (US); Daniel Robert Hostetter, Palto Alto, CA (US); Olga Vasiljeva, Cupertino, CA (US); Jason Gary Sagert, San Mateo, CA (US); Jonathan Alexander Terrett, Cupertino, CA (US)

(73) Assignee: CYTOMX THERAPEUTICS, INC., South San Francisco, CA (US)

( * ) Notice: Subject to any disclaimer, the term of this patent is extended or adjusted under 35 U.S.C. 154(b) by 0 days.

(21) Appl. No.: 16/428,767

(22) Filed: May 31, 2019

(65) Prior Publication Data

US 2019/0382493 A1    Dec. 19, 2019

Related U.S. Application Data

(62) Division of application No. 15/069,622, filed on Mar. 14, 2016, now Pat. No. 10,336,824.

(60) Provisional application No. 62/218,883, filed on Sep. 15, 2015, provisional application No. 62/139,596, filed on Mar. 27, 2015, provisional application No. 62/133,231, filed on Mar. 13, 2015.

(51) Int. Cl.
*A61K 39/395* (2006.01)
*C07K 16/28* (2006.01)
*A61K 49/00* (2006.01)
*A61K 39/00* (2006.01)

(52) U.S. Cl.
CPC ...... *C07K 16/2827* (2013.01); *A61K 39/3955* (2013.01); *A61K 49/0021* (2013.01); *A61K 49/0041* (2013.01); *A61K 49/0058* (2013.01); *A61K 2039/505* (2013.01); *C07K 2317/21* (2013.01); *C07K 2317/33* (2013.01); *C07K 2317/34* (2013.01); *C07K 2317/55* (2013.01); *C07K 2317/56* (2013.01); *C07K 2317/565* (2013.01); *C07K 2317/567* (2013.01); *C07K 2317/622* (2013.01); *C07K 2317/70* (2013.01); *C07K 2317/73* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | |
|---|---|---|
| 5,030,719 A | 7/1991 | Umemoto et al. |
| 5,151,510 A | 9/1992 | Stec et al. |
| 6,803,192 B1 | 10/2004 | Chen |
| 6,936,704 B1 | 8/2005 | Freeman et al. |
| 7,038,013 B2 | 5/2006 | Freeman et al. |
| 7,101,550 B2 | 9/2006 | Wood et al. |
| 7,105,328 B2 | 9/2006 | Wood et al. |
| 7,432,351 B1 | 10/2008 | Chen |
| 7,449,300 B2 | 11/2008 | Chen et al. |
| 7,465,790 B2 | 12/2008 | Waldmann et al. |
| 7,635,757 B2 | 12/2009 | Freeman et al. |
| 7,666,817 B2 | 2/2010 | Daugherty et al. |
| 7,700,301 B2 | 4/2010 | Wood et al. |
| 7,709,214 B2 | 5/2010 | Freeman et al. |
| 7,722,868 B2 | 5/2010 | Freeman et al. |
| 7,794,710 B2 | 9/2010 | Chen et al. |
| 7,892,540 B2 | 2/2011 | Chen et al. |
| 7,931,896 B2 | 4/2011 | Chen |
| 7,943,743 B2 | 5/2011 | Korman et al. |
| 8,062,852 B2 | 11/2011 | Mozaffarian et al. |
| 8,168,179 B2 | 5/2012 | Honjo et al. |
| 8,217,149 B2 | 7/2012 | Irving et al. |
| 8,273,864 B2 | 9/2012 | Chen |
| 8,383,796 B2 | 2/2013 | Korman et al. |
| 8,460,927 B2 | 6/2013 | Chen |
| 8,507,663 B2 | 8/2013 | Defougerolles et al. |
| 8,513,390 B2 | 8/2013 | Stagliano et al. |
| 8,518,404 B2 | 8/2013 | Daugherty et al. |
| 8,529,898 B2 | 9/2013 | Daugherty et al. |

(Continued)

FOREIGN PATENT DOCUMENTS

| | | |
|---|---|---|
| CN | 105461808 | 4/2016 |
| CN | 105777906 | 7/2016 |

(Continued)

OTHER PUBLICATIONS

Anonymous, "NCT03013491: PROCLAIM-CX-072: A Trial to Find Safe and Active Doese of an Investigational Drug CX-072 for Patients with Solid Tumors or Lyphomas", (May 18, 2017). Retrieved on Sep. 12, 2018: URL: https://clinicaltrials.gov/ct2/history/NCT03013491?V_9=View#StudyPageTop.

(Continued)

*Primary Examiner* — Meera Natarajan
(74) *Attorney, Agent, or Firm* — Fish & Richardson P.C.

(57) ABSTRACT

The invention relates generally to antibodies that bind programmed death ligand 1 (PDL1), activatable antibodies that specifically bind to PDL1 and methods of making and using these anti-PDL1 antibodies and anti-PDL1 activatable antibodies in a variety of therapeutic, diagnostic and prophylactic indications.

44 Claims, 28 Drawing Sheets

Specification includes a Sequence Listing.

(56) References Cited

U.S. PATENT DOCUMENTS

| | | |
|---|---|---|
| 8,541,203 B2 | 9/2013 | Daugherty et al. |
| 8,552,154 B2 | 10/2013 | Freeman et al. |
| 8,563,269 B2 | 10/2013 | Stagliano et al. |
| 8,617,546 B2 | 12/2013 | Kang et al. |
| 8,652,465 B2 | 2/2014 | Freeman et al. |
| 8,741,295 B2 | 6/2014 | Olive |
| 8,747,833 B2 | 6/2014 | Chen et al. |
| 8,779,108 B2 | 7/2014 | Queva et al. |
| 8,809,504 B2 | 8/2014 | Lauermann |
| 8,962,804 B2 | 2/2015 | Williams et al. |
| 8,981,063 B2 | 3/2015 | Chen |
| 8,992,927 B1 | 3/2015 | Clube |
| 8,993,524 B2 | 3/2015 | Bedi et al. |
| 9,045,545 B1 | 6/2015 | Clube |
| 9,062,112 B2 | 6/2015 | Chen |
| 9,067,998 B1 | 6/2015 | Clube |
| 9,095,628 B2 | 8/2015 | Govindan et al. |
| 9,102,725 B2 | 8/2015 | Korman et al. |
| 9,102,727 B2 | 8/2015 | Korman et al. |
| 9,109,034 B1 | 8/2015 | Clube |
| 9,168,296 B2 | 10/2015 | Mozaffarian et al. |
| 9,169,321 B2 | 10/2015 | Daugherty et al. |
| 9,175,082 B2 | 11/2015 | Zhou et al. |
| 9,187,562 B1 | 11/2015 | Clube |
| 9,212,224 B2 | 12/2015 | Cogswell et al. |
| 9,221,917 B2 | 12/2015 | Baurin et al. |
| 9,273,135 B2 | 3/2016 | Korman et al. |
| 9,283,286 B2 | 3/2016 | Govindan et al. |
| 9,303,089 B2 | 4/2016 | Clube |
| 9,393,301 B2 | 7/2016 | Honjo et al. |
| 9,402,899 B2 | 8/2016 | Honjo et al. |
| 9,416,180 B1 | 8/2016 | Clube |
| 9,422,562 B2 | 8/2016 | DeFougerolles et al. |
| 9,428,578 B2 | 8/2016 | Clube |
| 9,439,962 B2 | 9/2016 | Honjo et al. |
| 9,439,963 B2 | 9/2016 | Clube |
| 9,453,078 B2 | 9/2016 | Stagliano et al. |
| 9,457,080 B2 | 10/2016 | Freeman et al. |
| 9,486,536 B2 | 11/2016 | Govindan et al. |
| 9,493,565 B2 | 11/2016 | Queva et al. |
| 9,567,399 B1 | 2/2017 | Campbell et al. |
| 9,580,505 B2 | 2/2017 | Korman et al. |
| 9,580,507 B2 | 2/2017 | Korman et al. |
| 9,617,338 B1 | 4/2017 | Campbell et al. |
| 9,624,298 B2 | 4/2017 | Nastri et al. |
| 9,650,429 B2 | 5/2017 | Ostrand-Rosenberg |
| 9,676,863 B2 | 6/2017 | Lo |
| 9,694,088 B2 | 7/2017 | Govindan et al. |
| 9,709,568 B2 | 7/2017 | Pierce et al. |
| 9,724,390 B2 | 8/2017 | Gurney |
| 9,765,147 B2 | 9/2017 | Wong et al. |
| 9,789,183 B1 | 10/2017 | Wang et al. |
| 9,828,434 B2 | 11/2017 | Marasco et al. |
| 9,845,356 B2 | 12/2017 | Freeman et al. |
| 9,856,320 B2 | 1/2018 | Cogswell et al. |
| 9,885,721 B2 | 2/2018 | Couto et al. |
| 9,907,849 B2 | 3/2018 | Petit et al. |
| 9,914,769 B2 | 3/2018 | Clube |
| 9,920,123 B2 | 3/2018 | Irving et al. |
| 9,957,323 B2 | 5/2018 | Sainson et al. |
| 9,987,258 B2 | 6/2018 | Villagra et al. |
| 9,988,452 B2 | 6/2018 | Freeman et al. |
| 10,011,656 B2 | 7/2018 | Freeman et al. |
| 10,059,769 B2 | 8/2018 | Fang et al. |
| 10,072,082 B2 | 9/2018 | Cogswell et al. |
| 10,077,308 B2 | 9/2018 | Wang et al. |
| 10,081,679 B2 | 9/2018 | BenMose et al. |
| 10,208,119 B2 | 2/2019 | Fang et al. |
| 10,336,824 B2 | 7/2019 | West et al. |
| 2004/0109855 A1 | 6/2004 | Waldmann et al. |
| 2009/0304719 A1 | 12/2009 | Daugherty et al. |
| 2009/0317368 A1 | 12/2009 | Chen |
| 2010/0189651 A1 | 7/2010 | Stagliano et al. |
| 2010/0203056 A1 | 8/2010 | Irving et al. |
| 2011/0280877 A1 | 11/2011 | Tamada |
| 2012/0149061 A1 | 6/2012 | Stagliano et al. |
| 2012/0207756 A1 | 8/2012 | Stagliano et al. |
| 2012/0237512 A1 | 9/2012 | Daugherty et al. |
| 2012/0237977 A1 | 9/2012 | Daugherty et al. |
| 2012/0244154 A1 | 9/2012 | Daugherty et al. |
| 2013/0045202 A1 | 2/2013 | Irving et al. |
| 2013/0071403 A1 | 3/2013 | Rolland et al. |
| 2013/0309230 A1 | 11/2013 | Stagliano et al. |
| 2013/0309250 A1 | 11/2013 | Cogswell et al. |
| 2013/0323249 A1 | 12/2013 | Zhou et al. |
| 2014/0024810 A1 | 1/2014 | Stagliano et al. |
| 2014/0045195 A1 | 2/2014 | Daugherty et al. |
| 2014/0065135 A1 | 3/2014 | Irving et al. |
| 2014/0341917 A1 | 11/2014 | Nastri et al. |
| 2014/0356363 A1 | 12/2014 | Queva et al. |
| 2015/0044165 A1 | 2/2015 | Chen et al. |
| 2015/0071910 A1 | 3/2015 | Kowanetz et al. |
| 2015/0073129 A1 | 3/2015 | Herting et al. |
| 2015/0125463 A1 | 5/2015 | Cogswell et al. |
| 2015/0202291 A1 | 7/2015 | Bosch et al. |
| 2015/0203580 A1 | 7/2015 | Papadopoulos et al. |
| 2015/0210772 A1 | 7/2015 | Kim |
| 2015/0232533 A1 | 8/2015 | Chen |
| 2015/0239972 A1 | 8/2015 | Ahmed et al. |
| 2015/0322153 A1 | 11/2015 | Irving et al. |
| 2015/0328311 A1 | 11/2015 | Narwal et al. |
| 2015/0344577 A1 | 12/2015 | Fu |
| 2015/0346210 A1 | 12/2015 | Nitta et al. |
| 2015/0352206 A1 | 12/2015 | Gajewski et al. |
| 2015/0355184 A1 | 12/2015 | Pierce et al. |
| 2016/0009805 A1 | 1/2016 | Kowanetz et al. |
| 2016/0031990 A1 | 2/2016 | Steele et al. |
| 2016/0045597 A1 | 2/2016 | Corse et al. |
| 2016/0060344 A1 | 3/2016 | Narwal et al. |
| 2016/0067336 A1* | 3/2016 | Fandi ............... A61K 31/7068 424/133.1 |
| 2016/0089434 A1 | 3/2016 | Hoos |
| 2016/0096889 A1 | 4/2016 | Chen |
| 2016/0096890 A1 | 4/2016 | Chen |
| 2016/0122425 A1 | 5/2016 | Daugherty et al. |
| 2016/0122829 A1 | 5/2016 | Hammerman |
| 2016/0130348 A1 | 5/2016 | Langermann et al. |
| 2016/0131646 A1 | 5/2016 | Mozaffarian et al. |
| 2016/0151515 A1 | 6/2016 | Joubert et al. |
| 2016/0175397 A1 | 6/2016 | Umana et al. |
| 2016/0176962 A1 | 6/2016 | Murriel et al. |
| 2016/0193239 A1 | 7/2016 | Baylin et al. |
| 2016/0206754 A1 | 7/2016 | Chang et al. |
| 2016/0222117 A1 | 8/2016 | Irving et al. |
| 2016/0222118 A1 | 8/2016 | Chen et al. |
| 2016/0222120 A1 | 8/2016 | Narwal et al. |
| 2016/0222121 A1 | 8/2016 | Johnson et al. |
| 2016/0228546 A1 | 8/2016 | Stagliano et al. |
| 2016/0251437 A1 | 9/2016 | Dong et al. |
| 2016/0272712 A1 | 9/2016 | Freeman et al. |
| 2016/0289343 A1 | 10/2016 | Wu |
| 2016/0303231 A1 | 10/2016 | Iannone et al. |
| 2016/0305947 A1 | 10/2016 | Pierce et al. |
| 2016/0319017 A1 | 11/2016 | Clube |
| 2016/0319022 A1 | 11/2016 | Yang et al. |
| 2016/0333414 A1 | 11/2016 | Beloov et al. |
| 2016/0340407 A1 | 11/2016 | Hodi et al. |
| 2016/0340429 A1 | 11/2016 | Waksal et al. |
| 2016/0347848 A1 | 12/2016 | Hammond et al. |
| 2016/0362460 A1 | 12/2016 | Olwill et al. |
| 2016/0362492 A1 | 12/2016 | Freeman et al. |
| 2017/0007693 A1 | 1/2017 | Weiner et al. |
| 2017/0007715 A1 | 1/2017 | Andreev et al. |
| 2017/0015758 A1 | 1/2017 | Hammond |
| 2017/0021019 A1 | 1/2017 | Zibelman et al. |
| 2017/0029508 A1 | 2/2017 | EisenbachSchwartz et al. |
| 2017/0037132 A1 | 2/2017 | Manekas et al. |
| 2017/0051060 A1 | 2/2017 | Honjo et al. |
| 2017/0056391 A1 | 3/2017 | Li |
| 2017/0058033 A1 | 3/2017 | Ludwig et al. |
| 2017/0081397 A1 | 3/2017 | Stagliano et al. |
| 2017/0089918 A1 | 3/2017 | Dong |
| 2017/0114137 A1 | 4/2017 | Li |
| 2017/0137522 A1 | 5/2017 | Queva et al. |

(56) References Cited

U.S. PATENT DOCUMENTS

| | | |
|---|---|---|
| 2017/0143780 A1 | 5/2017 | Zitvogel et al. |
| 2017/0158767 A1 | 6/2017 | Korman et al. |
| 2017/0182161 A1 | 6/2017 | Zhou et al. |
| 2017/0189476 A1 | 7/2017 | Sung et al. |
| 2017/0198051 A1 | 7/2017 | Eckelman et al. |
| 2017/0202902 A1 | 7/2017 | McLaughlin et al. |
| 2017/0204184 A1 | 7/2017 | Zha et al. |
| 2017/0224791 A1 | 8/2017 | Okamura et al. |
| 2017/0253653 A1 | 9/2017 | Nastri et al. |
| 2017/0253654 A1 | 9/2017 | Nastri et al. |
| 2017/0260271 A1 | 9/2017 | Igawa et al. |
| 2017/0266310 A1 | 9/2017 | Govindan et al. |
| 2017/0267756 A1 | 9/2017 | Riddell et al. |
| 2017/0281765 A1 | 10/2017 | Zhou et al. |
| 2017/0290808 A1 | 10/2017 | Charo et al. |
| 2017/0290923 A1 | 10/2017 | Li et al. |
| 2017/0306050 A1 | 10/2017 | Degenhardt et al. |
| 2017/0306025 A1 | 11/2017 | Barry et al. |
| 2017/0320954 A1 | 11/2017 | Barry et al. |
| 2017/0327583 A1 | 11/2017 | Campbell et al. |
| 2017/0362321 A1 | 12/2017 | Campbell et al. |
| 2017/0367997 A1 | 12/2017 | Kawakami et al. |
| 2018/0000851 A1 | 1/2018 | Krieg |
| 2018/0002423 A1 | 1/2018 | Wang et al. |
| 2018/0002424 A1 | 1/2018 | Belk et al. |
| 2018/0002436 A1 | 1/2018 | Lo |
| 2018/0015161 A1 | 1/2018 | Weiner et al. |
| 2018/0016555 A1 | 1/2018 | Borges et al. |
| 2018/0022809 A1 | 1/2018 | Kowanetz et al. |
| 2018/0031567 A1 | 2/2018 | Dennis et al. |
| 2018/0071340 A1 | 3/2018 | Avigan et al. |
| 2018/0078626 A1 | 3/2018 | Avigan et al. |
| 2018/0078650 A1 | 3/2018 | Avigan et al. |
| 2018/0085350 A1 | 3/2018 | Avigan et al. |
| 2018/0085398 A1 | 3/2018 | Avigan et al. |
| 2018/0094067 A1 | 4/2018 | Wong et al. |
| 2018/0155430 A1 | 6/2018 | Ahmed et al. |
| 2018/0155431 A1 | 6/2018 | Herting et al. |
| 2018/0161464 A1 | 6/2018 | Kelly et al. |
| 2018/0162942 A1 | 6/2018 | Simon et al. |
| 2018/0171025 A1 | 6/2018 | Kim |
| 2018/0196055 A1 | 6/2018 | Couto et al. |
| 2018/0185482 A1 | 7/2018 | Sheng et al. |
| 2018/0185483 A1 | 7/2018 | Petit et al. |
| 2018/0186882 A1 | 7/2018 | Freeman et al. |
| 2018/0200338 A1 | 7/2018 | Umana et al. |
| 2018/0201680 A1 | 7/2018 | Freeman et al. |
| 2018/0230431 A1 | 8/2018 | Bi et al. |
| 2018/0238884 A1 | 8/2018 | Bass et al. |
| 2018/0273624 A1 | 9/2018 | Cogswell et al. |
| 2018/0274038 A1 | 9/2018 | Beloov et al. |
| 2018/0282413 A1 | 10/2018 | Cogswell et al. |
| 2018/0282414 A1 | 10/2018 | Cogswell et al. |
| 2018/0296614 A1 | 10/2018 | Eigner et al. |
| 2018/0305437 A1 | 10/2018 | Wahlberg |
| 2018/0312565 A1 | 11/2018 | Wahlberg et al. |
| 2018/0312590 A1 | 11/2018 | Cogswell et al. |
| 2018/0319887 A1 | 11/2018 | Cogswell et al. |
| 2018/0346574 A1 | 12/2018 | Fang et al. |
| 2019/0016807 A1 | 1/2019 | Irving et al. |
| 2019/0016814 A1 | 1/2019 | Humphrey et al. |
| 2019/0106494 A1 | 4/2019 | Wang et al. |

FOREIGN PATENT DOCUMENTS

| | | |
|---|---|---|
| CN | 106243225 | 12/2016 |
| CN | 106478819 | 3/2017 |
| CN | 106699891 | 5/2017 |
| CN | 106978400 | 7/2017 |
| CN | 107459578 | 12/2017 |
| CN | 107973854 | 5/2018 |
| CN | 108250296 | 7/2018 |
| CN | 108276492 | 7/2018 |
| CN | 106977602 | 9/2018 |
| CN | 106243223 | 3/2019 |
| EP | 1523503 | 4/2009 |
| EP | 1324771 | 6/2011 |
| EP | 1907000 | 10/2012 |
| EP | 2172219 | 9/2013 |
| EP | 1907424 | 7/2015 |
| EP | 2982379 | 2/2016 |
| EP | 2079760 | 4/2016 |
| EP | 3070102 | 9/2016 |
| EP | 2397156 | 11/2016 |
| EP | 1234031 | 3/2017 |
| EP | 2376535 | 4/2017 |
| EP | 2393835 | 4/2017 |
| EP | 2133365 | 5/2017 |
| EP | 2542590 | 5/2017 |
| EP | 2397155 | 12/2017 |
| EP | 1810026 | 4/2018 |
| KR | 2018-0016321 | 2/2018 |
| RU | 2665790 | 2/2018 |
| TW | 201718657 | 6/2017 |
| WO | WO 1994/011026 | 5/1994 |
| WO | WO 2001/14557 | 3/2001 |
| WO | WO 2001/091798 | 12/2001 |
| WO | WO 2002/030460 | 4/2002 |
| WO | WO 2004/009638 | 1/2004 |
| WO | WO 2007/105027 | 9/2007 |
| WO | WO 2009/025846 | 2/2009 |
| WO | WO 2010/081173 | 7/2010 |
| WO | WO 2011/066389 | 6/2011 |
| WO | WO 2012/145493 | 10/2012 |
| WO | WO 2013/019906 | 2/2013 |
| WO | WO 2013/128194 | 9/2013 |
| WO | WO 2013/163631 | 10/2013 |
| WO | WO 2013/173223 | 11/2013 |
| WO | WO 2013/192546 | 12/2013 |
| WO | WO 2014/026136 | 2/2014 |
| WO | WO 2014/055897 | 4/2014 |
| WO | WO 2014/074852 | 5/2014 |
| WO | WO 2014/100079 | 6/2014 |
| WO | WO 2014/100439 | 6/2014 |
| WO | WO 2014/100483 | 6/2014 |
| WO | WO 2014/107599 | 7/2014 |
| WO | WO 2014/116846 | 7/2014 |
| WO | WO 2014/151006 | 9/2014 |
| WO | WO 2014/165082 | 10/2014 |
| WO | WO 2014/195852 | 12/2014 |
| WO | WO 2015/013671 | 1/2015 |
| WO | WO 2015/038538 | 3/2015 |
| WO | WO 2015/048520 | 4/2015 |
| WO | WO 2015/069697 | 5/2015 |
| WO | WO 2015/069770 | 5/2015 |
| WO | WO 2015/081158 | 6/2015 |
| WO | WO 2015/092393 | 6/2015 |
| WO | WO 2015/095404 | 6/2015 |
| WO | WO 2015/109124 | 7/2015 |
| WO | WO 2015/195163 | 12/2015 |
| WO | WO 2016/000619 | 1/2016 |
| WO | WO 2016/006241 | 1/2016 |
| WO | WO 2016/030455 | 3/2016 |
| WO | WO 2016/050721 | 4/2016 |
| WO | WO 2016/059602 | 4/2016 |
| WO | WO 2016/062722 | 4/2016 |
| WO | WO 2016/071701 | 5/2016 |
| WO | WO 2016/075174 | 5/2016 |
| WO | WO 2016/115274 | 7/2016 |
| WO | WO 2016/124558 | 8/2016 |
| WO | WO 2016/128912 | 8/2016 |
| WO | WO 2016/137985 | 9/2016 |
| WO | WO 2016/146329 | 9/2016 |
| WO | WO 2016/149201 | 9/2016 |
| WO | WO 2016/154412 | 9/2016 |
| WO | WO 2016/156501 | 10/2016 |
| WO | WO 2016/160792 | 10/2016 |
| WO | WO 2016/172249 | 10/2016 |
| WO | WO 2016/175275 | 11/2016 |
| WO | WO 2016/181348 | 11/2016 |
| WO | WO 2016/183326 | 11/2016 |
| WO | WO 2016/196381 | 12/2016 |
| WO | WO 2016/197367 | 12/2016 |
| WO | WO 2016/205277 | 12/2016 |

(56) References Cited

FOREIGN PATENT DOCUMENTS

| WO | WO 2017/004192 | 1/2017 |
|---|---|---|
| WO | WO 2017/020802 | 2/2017 |
| WO | WO 2017/020858 | 2/2017 |
| WO | WO 2017/059387 | 4/2017 |
| WO | WO 2017/062797 | 4/2017 |
| WO | WO 2017/084495 | 5/2017 |
| WO | WO 2017/087547 | 5/2017 |
| WO | WO 2017/087851 | 5/2017 |
| WO | WO 2017/097407 | 6/2017 |
| WO | WO 2017/120604 | 7/2017 |
| WO | WO 2017/136562 | 8/2017 |
| WO | WO 2017/136820 | 8/2017 |
| WO | WO 2017/148424 | 9/2017 |
| WO | WO 2017/196867 | 11/2017 |

OTHER PUBLICATIONS

Baecher-Allan et al. (2001) "CD4+CD25high Regulatory Cells in Human Peripheral Blood" J Immunol, 167:1245-1253.

Boni et al., "The First-in-Human, Dose-Finding PROCLAIM-CX-072 Trial to Assess the Antitumor Activity and Tolerability of the Probody® Therapeutic CX-072 as Monotherapy and in Combination with Pilinnumab or Vermarafenib in Solid Advanced Tumors and Lyphomas", CytomXTherapeutics, Inc., Poster presented at ESMO (European Society of Medical Oncology) 2017 Congress; Sep. 8-12, 2017, Madrid, Spain.

Boulware et al. (Jun. 15, 2010) "Evolutionary Optimization of Peptide Substrates for Proteases That Exhibit Rapid Hydrolysis Kinetics" Biotechnology & Bioengineering, 106(3):339-346.

Brown et al. (2003) "Blockade of Programmed Death-I Ligands on Dendritic Cells Enhances T Cell Activation and Cytokine Production" J Immunol, 170:1257-1266.

Carreno et al. (2002) "The B7 Family of LIgands and its Receptors: New Pathways for Costimulation and Inhibition of Immunie Responses" Annu Rev Immunol, 20:29-53.

Chen et al., ""Molecular Pathways: Next-Generation Immunotherapy—Inhibiting Programmed Death-Ligand 1 and Programmed Death-1,"" Clin. Can. Res. 18:6580-6587 (2012).

CytomX Therapeutics Company Overview. Mar. 13, 2015; 27 pages.

CytomX Therapeutics Company Overview. Presented Mar. 2, 2015,at Cowen and Company Annual Healthcare Conference,Boston Massachusetts; 27 pages.

Deng et al. (2016) "Preclinical pharmacokinetics, pharmacodynamics, tissue distribution, and tumor penetration ofanti-PD-LI monoclonal antibody; an immune checkpoint inhibitor" MAES, 8(3):593-603.

Desnoyers et al (Oct. 16, 2013) "Tumor Specific Activation of an EGFR- Targeting Probody Enhances Therapeutic Index" Sci Transl Med, 5:207ra1 44 [online]. Retrieved from: http://stm.sciencemag.org/, on Dec. 21, 2018, 11 pages.

Dong et al. (1999) "B7-H1, a third member ofthe B7 fmaily, co-stimulates T-cell proliferation and interleukin-1O secretion" Nat med, 5(12):1365-1369.

Dong et al. (Aug. 2002) "Tumor-associated B7H1 promotes T-cell apoptosis: A potential mechanism of immune evasion" Nat Med, 8(8):793-800.

Freeman et al. (Oct. 2, 2000) "Engagement of the PD-1 Immunoinhibitory Receptor by a Novel B7 Family Member Leads to Negative Regulation ofLymphocyte Activation" J Exp Med, 192(7):1027-1034.

Herbst et al. (Nov. 27, 2014) "Predictive correlates ofresponse to the anti-PD-LI antibody MPDL3280A in cancer patients"Nature, 515-563-567; including Methods and additional Extende Data Display items and Source Data, 18 total pages.

Irving et al., "Probodies Empower a New Generation of Antibody Immunotherapies," presented at Keystone Symposia on Molecular and Cellular Biology, Feb. 2015.

Iwai et al (Sep. 17, 2002) "Involvement ofPD-LI on tumor cells in the escape from host immune system and tumor immunotherapy by PD-LI blockade" PNAS, 99(19):12293-12297.

Kanai et al. (2003) "Blockade ofB7-HI Suppresses the Development ofChronic Intestinal Inflammation" J Immunol, 171:4156-4163.

Latchman et al. (Mar. 2001) "PD-L2 is a second ligand for PD-1 and inhibits T cell activation" Nat Immunol, 2(3):261-268.

LeBeau et al. "Imaging a functional tumorigenic biomarker in the transformed epithelium", Proc. Natl. Acad. Sci. USA (2013) 110(1):93-98.

Overall et al., "Validating Matrix Metalloproteinases as Drug Targets and Anti-Targets for Cancer Therapy", Nature Rev. Can. (2006) 6:227-239.

Sharpe et al. (Feb. 2002) "The B7-CD28 Superfamily" Nat Rev Immunol, 2:116-126.

Spira et al., "PROCLAIM-CX-072: A First-in-Human Trial to Assess Tolerability of the Protease-Activable Anti-PD-L1 Probody® CX-072 in Solid Tumors and Lymphomas", CytomX Therapeutics, Inc., Poster TPS3107, Presented at ASCO Annual Meeting; Jun. 2-6, 2017; Chicago, Illinois.

Wolchok et al., "Nivolumab plus ipilimaumab in advanced melanoma", N. Engl. J. Med. (2013) 369(2):122-133.

Wong et al. (2015) "A PD-LI-targeted Probody1M Therapeutic Provides Anti-Tumor Efficacy While Minimizing Induction of Systemic Autoimmunity in Preclinical Studies" CytomX Therapeutics. Poster presented at the CRI-CIMT-EATI-MCR—The Inaugural International Cancer Immunotherapy Conference: Translating Science into Survival. New York, NY, Sep. 16, 2019, 2015.

PCT International Search Report and Written Opinion in International Appln. No. PCT/US2018/035508, dated Sep. 27, 2018, 15 pages.

PCT International Preliminary Report on Patentability in International Appln. No. PCT/US2018/035508, dated Dec. 12, 2019, 8 pages.

\* cited by examiner msPDL1-Fc hCD28-Fc hB7-1

C5H9
C5H9 Lc 20 hIgG1 monomer 65%

C5H9v2
C5H9 Lc Mod 20 hIgG1 monomer 90% hPDL1/Fc mask efficiency

| Mask efficiency | PL09 | PL10 | PL11 | PL12 | PL13 | PL14 | PL15 |
|---|---|---|---|---|---|---|---|
| hPDL1 | 31 | 63 | 12 | 88 | 1.4 | 26 | 2 |
| mPDL1 | 1518 | 2246 | 251 | 2940 | 4 | 1012 | 48 |

**C15-002 PD-L1 Pb
in 9 wk old Female NOD Mice**

|  | C5H9v2 | PL07-2001 C5H9v2 + UPA | PL07-2001 C5H9v2 + MMP | PL07-2001 C5H9v2 |
|---|---|---|---|---|
| IC50 (nM) | 0.7 | 0.7 | 0.7 | 39.8 |
| ME | 1 | 1 | 1 | 57 |

|  | C5H9v2 | PL07-2001 C5H9v2 + UPA | PL07-2001 C5H9v2 + MMP | PL07-2001 C5H9v2 |
|---|---|---|---|---|
| IC50 (nM) | 0.3 | 0.3 | 0.3 | 7 |
| ME | 1 | 1 | 1 | 23 |

| | C5H9v2 | PL07-2001 C5H9v2 + UPA | PL07-2001 C5H9v2 + MMP | PL07-2001 C5H9v2 |
|---|---|---|---|---|
| IC50 (nM) | 0.3 | 0.3 | 0.3 | 11.9 |
| ME | 1 | 1 | 1 | 40 |

| | C5H9v2 | PL07-2001 C5H9v2 + UPA | PL07-2001 C5H9v2 + MMP | PL07-2001 C5H9v2 |
|---|---|---|---|---|
| IC50 (nM) | 0.5 | 0.5 | 0.4 | 11.7 |
| ME | 1 | 1 | 1 | 29 |

|  | C5H9v2 | PL07-2001 C5H9v2 + UPA | PL07-2001 C5H9v2 + MMP | PL07-2001 C5H9v2 |
|---|---|---|---|---|
| IC50 (nM) | 0.1 | 0.1 | 0.1 | 9.6 |
| ME | 1 | 1 | 1 | 96 |

ANTI-PDL1 ANTIBODIES, ACTIVATABLE ANTI-PDL1 ANTIBODIES, AND METHODS OF USE THEREOF

RELATED APPLICATIONS

This application is a divisional of U.S. application Ser. No. 15/069,622, filed Mar. 14, 2016, which claims the benefit of U.S. Provisional Application No. 62/133,231, filed Mar. 13, 2015; U.S. Provisional Application No. 62/139, 596, filed Mar. 27, 2015; and U.S. Provisional Application No. 62/218,883, filed Sep. 15, 2015; the contents of each of which are incorporated herein by reference in their entirety.

INCORPORATION BY REFERENCE OF SEQUENCE LISTING

The instant application contains a Sequence Listing which has been filled electronically in ASII format and is hereby incorporated by reference in its entirety. Said ASII copy, created on Nov. 20, 2019, is named 42325-0008003_SL.txt and is 823,366 bytes in size.

FIELD OF THE INVENTION

The invention relates generally to antibodies that bind programmed death ligand 1 (PDL1), activatable antibodies that specifically bind to PDL1 and methods of making and using these anti-PDL1 antibodies and anti-PDL1 activatable antibodies in a variety of therapeutic, diagnostic and prophylactic indications.

BACKGROUND OF THE INVENTION

Antibody-based therapies have proven effective treatments for several diseases but in some cases, toxicities due to broad target expression have limited their therapeutic effectiveness. In addition, antibody-based therapeutics have exhibited other limitations such as rapid clearance from the circulation following administration.

In the realm of small molecule therapeutics, strategies have been developed to provide prodrugs of an active chemical entity. Such prodrugs are administered in a relatively inactive (or significantly less active) form. Once administered, the prodrug is metabolized in vivo into the active compound. Such prodrug strategies can provide for increased selectivity of the drug for its intended target and for a reduction of adverse effects.

Accordingly, there is a continued need in the field of antibody-based therapeutics for antibodies that mimic the desirable characteristics of the small molecule prodrug.

SUMMARY OF THE INVENTION

The disclosure provides antibodies or antigen-binding fragments thereof that specifically bind programmed death ligand 1 (PDL1), also known as PD-L1, CD274, B7 homolog 1 and/or B7-H1. The use of the term "PDL1" is intended to cover any variation thereof, such as, by way of non-limiting example, PD-L1 and/or PDL-1, all variations are used herein interchangeably.

In some embodiments, the antibody includes an antibody or antigen-binding fragment thereof that specifically binds PDL1. In some embodiments, the antibody or antigen binding fragment thereof that binds PDL1 is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, such an antibody or antigen binding fragment thereof that binds PDL1 is a mouse, other rodent, chimeric, humanized or fully human monoclonal antibody.

In some embodiments, the antibody is an isolated antibody or antigen binding fragment thereof (AB) that specifically binds to mammalian PDL1, wherein the AB has one or more of the following characteristics: (a) the AB specifically binds to human PDL1 and murine PDL1; (b) the AB specifically binds to human PDL1 and cynomolgus monkey PDL1; (c) the AB specifically binds to human PDL1, murine PDL1, and cynomolgus monkey PDL1; (d) the AB inhibits binding of human B7-1 and human PD1 to human PDL1 with an $EC_{50}$ value less than 10 nM; (e) the AB inhibits binding of murine B7-1 and murine PD1 to murine PDL1 with an $EC_{50}$ value less than 10 nM; and (f) the AB inhibits binding of cynomolgus monkey B7-1 and cynomolgus monkey PD1 to cynomolgus monkey PDL1 with an $EC_{50}$ value less than 10 nM.

In some embodiments, the antibody or antigen binding fragment thereof specifically binds to the mammalian PDL1 with a dissociation constant is less than or equal to 0.01 nM, less than or equal to 0.05 nM, less than or equal to 0.1 nM, less than or equal to 0.2 nM, less than or equal to 0.3 nM, less than or equal to 0.4 nM, less than or equal to 0.5 nM, less than or equal to 0.75 nM, and less than or equal to 1 nM.

In some embodiments, the antibody or antigen binding fragment thereof specifically binds to the mammalian PDL1 with a dissociation constant in the range of 0.01 nM to 1 nM, 0.05 nM to 1 nM, 0.1 nM to 1 nM, 0.2 nM to 1 nM, 0.3 nM to 1 nM, 0.4 nM to 1 nM, 0.5 nM to 1 nM, 0.75 nM to 1 nM, 0.01 nM to 0.75 nM, 0.05 nM to 0.75 nM, 0.1 nM to 0.75 nM, 0.2 nM to 0.75 nM, 0.3 nM to 0.75 nM, 0.4 nM to 0.75 nM, 0.5 nM to 0.75 nM, 0.01 nM to 0.5 nM, 0.05 nM to 0.5 nM, 0.1 nM to 0.5 nM, 0.2 nM to 0.5 nM, 0.3 nM to 0.5 nM, 0.4 nM to 0.5 nM, 0.01 nM to 0.4 nM, 0.05 nM to 0.4 nM, 0.1 nM to 0.4 nM, 0.2 nM to 0.4 nM, 0.3 nM to 0.4 nM, 0.01 nM to 0.3 nM, 0.05 nM to 0.3 nM, 0.1 nM to 0.3 nM, 0.2 nM to 0.3 nM, 0.01 nM to 0.2 nM, 0.05 nM to 0.2 nM, 0.1 nM to 0.2 nM, 0.01 nM to 0.1 nM, 0.05 nM to 0.1 nM, or 0.01 nM to 0.05 nM.

In some embodiments, the mammalian PDL1 is selected from the group consisting of a human PDL1, a murine PDL1, a rat PDL1, and a cynomolgus monkey PDL1.

In some embodiments, the antibody or antigen binding fragment thereof specifically binds to human PDL1, murine PDL1 or cynomolgus monkey PDL1 with a dissociation constant of less than 1 nM.

In some embodiments, the mammalian PDL1 is a human PDL1.

In some embodiments, the antibody or antigen binding fragment thereof has one or more of the following characteristics: (a) the AB specifically binds human PDL1, murine PDL1, and cynomolgus monkey PDL1; (b) the AB inhibits binding of human B7-1 and human PD1 to human PDL1; (c) the AB inhibits binding of murine B7-1 and murine PD1 to murine PDL1; and (d) the AB inhibits binding of cynomolgus monkey B7-1 and cynomolgus monkey PD1 to cynomolgus monkey PDL1.

In some embodiments, the antibody or antigen binding fragment thereof blocks the ability of a natural ligand to bind to the mammalian PDL1 with an $EC_{50}$ less than or equal to 0.5 nM, less than or equal to 1 nM, less than or equal to 2 nM, less than or equal to 3 nM, less than or equal to 4 nM, less than or equal to 5 nM, less than or equal to 6 nM, less than or equal to 7 nM, less than or equal to 8 nM, less than or equal to 9 nM, and/or less than or equal to 10 nM.

In some embodiments, the antibody or antigen binding fragment thereof blocks the ability of a natural ligand to bind to the mammalian PDL1 with an $EC_{50}$ in the range of 0.5 nM to 10 nM, 0.5 nM to 5 nM, 0.5 nM to 3 nM, 0.5 nM to 2 nM, 0.5 nM to 1 nM, 1 nM to 10 nM, 1 nM to 5 nM, 1 nM to 3 nM, 1 nM to 2 nM, 2 nM to 10 nM, 2 nM to 5 nM, 2 nM to 3 nM, 3 nM to 10 nM, 3 nM to 5 nM, or 5 nM to 10 nM. In some embodiments, the natural ligand is a mammalian PD1. In some embodiments, the natural ligand is selected from the group consisting of: a human PD1, a murine PD1, and a cynomolgus monkey PD1.

In some embodiments, the natural ligand is a mammalian B7-1. In some embodiments, the natural ligand is selected from the group consisting of: a human B7-1, a murine B7-1, and a cynomolgus monkey B7-1.

In some embodiments, the antibody comprises a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, the antibody comprises a light chain amino acid sequence comprising SEQ ID NO: 12 or SEQ ID NO: 58. In some embodiments, the antibody comprises a light chain amino acid sequence comprising SEQ ID NO: 12. In some embodiments, the antibody comprises a light chain amino acid sequence comprising SEQ ID NO: 58.

In some embodiments, the antibody comprises a heavy chain amino acid sequence comprising an amino acid sequence selected from the group consisting of SEQ ID NO: 46, 48, 50, 52, 54, and 56, and a light chain amino acid sequence comprising SEQ ID NO: 58.

In some embodiments, the antibody comprises a heavy chain amino acid sequence comprising an amino acid sequence selected from the group consisting of SEQ ID NO: 46, 48, 50, 52, 54, and 56, and a light chain amino acid sequence comprising SEQ ID NO: 12.

In some embodiments, the antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, the antibody comprises a light chain amino acid that is at least 90%, 91%, 92%, 93%, 94%, 95%, 96%, 97%, 98% or 99% identical to the amino acid sequence of SEQ ID NO: 58. In some embodiments, the antibody comprises a light chain amino acid that is at least 90%, 91%, 92%, 93%, 94%, 95%, 96%, 97%, 98% or 99% identical to the amino acid sequence of SEQ ID NO: 12. In some embodiments, the antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a light chain amino acid that is at least 90%, 91%, 92%, 93%, 94%, 95%, 96%, 97%, 98% or 99% identical to the amino acid sequence of SEQ ID NO: 58. In some embodiments, the antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a light chain amino acid that is at least 90%, 91%, 92%, 93%, 94%, 95%, 96%, 97%, 98% or 99% identical to the amino acid sequence of SEQ ID NO: 12.

In some embodiments, the antibody comprises the heavy chain amino acid sequence of SEQ ID NO: 46 and the light chain amino acid sequence of SEQ ID NO: 58. In some embodiments, the antibody comprises the heavy chain amino acid sequence of SEQ ID NO: 46 and the light chain amino acid sequence of SEQ ID NO: 12.

In some embodiments, the antibody comprises a heavy chain amino acid sequence that is at least 90%, 91%, 92%, 93%, 94%, 95%, 96%, 97%, 98% or 99% identical to the amino acid of SEQ ID NO: 46. In some embodiments, the antibody comprises a light chain amino acid that is at least 90%, 91%, 92%, 93%, 94%, 95%, 96%, 97%, 98% or 99% identical to the amino acid sequence of SEQ ID NO: 58. In some embodiments, the antibody comprises a light chain amino acid that is at least 90%, 91%, 92%, 93%, 94%, 95%, 96%, 97%, 98% or 99% identical to the amino acid sequence of SEQ ID NO: 12. In some embodiments, the antibody comprises a heavy chain amino acid sequence that is at least 90%, 91%, 92%, 93%, 94%, 95%, 96%, 97%, 98% or 99% identical to the amino acid sequence selected of SEQ ID NO: 46, and a light chain amino acid that is at least 90%, 91%, 92%, 93%, 94%, 95%, 96%, 97%, 98% or 99% identical to the amino acid sequence of SEQ ID NO: 58. In some embodiments, the antibody comprises a heavy chain amino acid sequence that is at least 90%, 91%, 92%, 93%, 94%, 95%, 96%, 97%, 98% or 99% identical to the amino acid sequence selected of SEQ ID NO: 46, and a light chain amino acid that is at least 90%, 91%, 92%, 93%, 94%, 95%, 96%, 97%, 98% or 99% identical to the amino acid sequence of SEQ ID NO: 12.

In some embodiments, the antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 16; a VH CDR2 sequence shown in Table 16; a VH CDR3 sequence shown in Table 16; a VL CDR1 sequence shown in Table 16; a VL CDR2 sequence shown in Table 16; and a VL CDR3 sequence shown in Table 16.

In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 16; a VH CD2 sequence that includes a sequence that is at least 90%, 91%, 92%, 93%, 94%, 95%, 96%, 97%, 98%, 99% or more identical to a VH CDR2 sequence shown in Table 16; a VH CDR3 sequence that includes a sequence that is at least 90%, 91%, 92%, 93%, 94%, 95%, 96%, 97%, 98%, 99% or more identical to a VH CDR3 sequence shown in Table 16; a VL CDR1 sequence that includes a sequence that is at least 90%, 91%, 92%, 93%, 94%, 95%, 96%, 97%, 98%, 99% or more identical to a VL CDR1 sequence shown in Table 16; a VL CDR2 sequence that includes a sequence that is at least 90%, 91%, 92%, 93%, 94%, 95%, 96%, 97%, 98%, 99% or more identical to a VL CDR2 sequence shown in Table 16; and a VL CDR3 sequence that includes a sequence that is at least 90%, 91%, 92%, 93%, 94%, 95%, 96%, 97%, 98%, 99% or more identical to a VL CDR3 sequence shown in Table 16.

In some embodiments, the antibody comprises a heavy chain that comprise a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 16.

In some embodiments, the antibody comprises a light chain that comprise a combination of a VL CDR1 sequence, a VL CDR2 sequence, and a VL CDR3 sequence, wherein the combination is a combination of the three light chain CDR sequences (VL CDR1, VL CDR2, VL CDR3) shown in a single row in Table 16.

In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 16.

In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of the six CDR sequences (VH CDR1, VH CDR2, VH CDR3, VL CDR1, VL CDR2, and VL CDR3) shown in a single row in Table 16.

In some embodiments, the antibody comprises a heavy chain that comprise a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 16.

In some embodiments, the antibody comprises a light chain that comprise a combination of a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of the three light chain CDR sequences (VL CDR1, VL CDR2, VL CDR3) shown in a single row in Table 16.

In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein the VH CDR2 sequence comprises SSIWRNGIVTVYADS (SEQ ID NO: 246). In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein the VH CDR3 sequence comprises WSAAFDY (SEQ ID NO: 235). In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein the VH CDR2 sequence comprises SSIWRNGIVTVYADS (SEQ ID NO: 246), and the VH CDR3 sequence comprises WSAAFDY (SEQ ID NO: 235).

In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein the combination comprises a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, the antibody is encoded by a nucleic acid sequence that comprises a nucleic acid sequence encoding a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, the antibody is encoded by a nucleic acid sequence that comprises a nucleic acid sequence encoding a heavy chain amino acid sequence selected from the group consisting of SEQ ID NO: 46, 48, 50, 52, 54, and 56. In some embodiments, the antibody is encoded by a nucleic acid sequence that comprises a nucleic acid sequence encoding a light chain amino acid sequence comprising SEQ ID NO: 12 or SEQ ID NO: 58. In some embodiments, the antibody is encoded by a nucleic acid sequence that comprises a nucleic acid sequence encoding a light chain amino acid sequence comprising SEQ ID NO: 12. In some embodiments, the antibody is encoded by a nucleic acid sequence that comprises a nucleic acid sequence encoding a light chain amino acid sequence comprising SEQ ID NO: 58 In some embodiments, the antibody is encoded by a nucleic acid sequence that comprises a nucleic acid sequence encoding a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a nucleic acid sequence that comprises a nucleic acid sequence encoding a light chain amino acid sequence comprising SEQ ID NO: 58. In some embodiments, the antibody is encoded by a nucleic acid sequence that comprises a nucleic acid sequence encoding a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a nucleic acid sequence that comprises a nucleic acid sequence encoding a light chain amino acid sequence comprising SEQ ID NO: 12. In some embodiments, the antibody is encoded by a nucleic acid sequence that comprises a nucleic acid sequence encoding a heavy chain amino acid sequence selected from the group consisting of SEQ ID NO: 46, 48, 50, 52, 54, and 56, and a nucleic acid sequence that comprises a nucleic acid sequence encoding a light chain amino acid sequence comprising SEQ ID NO: 58. In some embodiments, the antibody is encoded by a nucleic acid sequence that comprises a nucleic acid sequence encoding a heavy chain amino acid sequence selected from the group consisting of SEQ ID NO: 46, 48, 50, 52, 54, and 56, and a nucleic acid sequence that comprises a nucleic acid sequence encoding a light chain amino acid sequence comprising SEQ ID NO: 12.

In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56. In some embodiments, the antibody is encoded by a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 58. In some embodiments, the antibody is encoded by a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 12. In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 58. In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 12. In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 12.

In some embodiments, the antibody is encoded by a heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55. In some embodiments, the antibody is encoded by a heavy chain nucleic acid sequence selected from the group consisting of SEQ ID NO: 45, 47, 49, 51, 53, and 55. In some embodiments, the antibody is encoded by the light chain nucleic acid sequence of SEQ ID NO: 57. In some embodiments, the antibody is encoded by the light chain nucleic acid sequence of SEQ ID NO: 11. In some embodiments, the antibody is encoded by heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55, and a light chain nucleic acid sequence comprising SEQ ID NO: 57. In some embodiments, the antibody is encoded by heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55, and a light chain nucleic acid sequence comprising SEQ ID NO: 11. In some embodiments, the antibody is encoded by a nucleic acid sequence that comprises a heavy chain nucleic acid sequence selected from the group consisting of SEQ ID NO: 45, 47, 49, 51, 53, and 55, and a light chain nucleic acid sequence comprising SEQ ID NO: 57. In some embodiments, the antibody is encoded by a nucleic acid sequence that comprises a heavy chain nucleic acid sequence selected from the group consisting of SEQ ID NO: 45, 47, 49, 51, 53, and 55, and a light chain nucleic acid sequence comprising SEQ ID NO: 11.

In some embodiments, the antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55. In some embodiments, the antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 45, 47, 49, 51, 53, and 55. In some embodiments, the antibody is encoded by a nucleic acid sequence that is at least 90%, 91%, 92%, 93%, 94%, 95%, 96%, 97%, 98% or 99% identical to the light chain nucleic acid sequence of SEQ ID NO: 57. In some embodiments, the antibody is encoded by a nucleic acid sequence that is at least 90%, 91%, 92%, 93%, 94%, 95%, 96%, 97%, 98% or 99% identical to the light chain nucleic acid sequence of SEQ ID NO: 11. In some embodiments, the antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55, and a nucleic acid sequence that is at least 90%, 91%, 92%, 93%, 94%, 95%, 96%, 97%, 98% or 99% identical to the light chain nucleic acid sequence comprising SEQ ID NO: 57. In some embodiments, the antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55, and a nucleic acid sequence that is at least 90%, 91%, 92%, 93%, 94%, 95%, 96%, 97%, 98% or 99% identical to the light chain nucleic acid sequence comprising SEQ ID NO: 11. In some embodiments, the antibody is encoded by a nucleic acid sequence that comprises a nucleic acid sequence that is at least 90%, 91%, 92%, 93%, 94%, 95%, 96%, 97%, 98% or 99% identical to heavy chain nucleic acid sequence selected from the group consisting of SEQ ID NO: 45, 47, 49, 51, 53, and 55, and a nucleic acid sequence that is at least 90%, 91%, 92%, 93%, 94%, 95%, 96%, 97%, 98% or 99% identical to light chain nucleic acid sequence comprising SEQ ID NO: 57. In some embodiments, the antibody is encoded by a nucleic acid sequence that comprises a nucleic acid sequence that is at least 90%, 91%, 92%, 93%, 94%, 95%, 96%, 97%, 98% or 99% identical to heavy chain nucleic acid sequence selected from the group consisting of SEQ ID NO: 45, 47, 49, 51, 53, and 55, and a nucleic acid sequence that is at least 90%, 91%, 92%, 93%, 94%, 95%, 96%, 97%, 98% or 99% identical to light chain nucleic acid sequence comprising SEQ ID NO: 11.

In some embodiments, the antibody or antigen-binding fragment thereof is incorporated in a multispecific antibody or antigen-binding fragment thereof, where at least one arm of the multispecific antibody specifically binds PDL1. In some embodiments, the antibody or antigen-binding fragment thereof is incorporated in a bispecific antibody or antigen-binding fragment thereof, where at least one arm of the bispecific antibody specifically binds PDL1.

In some embodiments, at least one arm of the multispecific antibody, e.g., a bispecific antibody, comprises a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, at least one arm of the multispecific antibody, e.g., a bispecific antibody, comprises a light chain amino acid sequence comprising SEQ ID NO: 12 or SEQ ID NO: 58. In some embodiments, at least one arm of the multispecific antibody, e.g., a bispecific antibody, comprises a light chain amino acid sequence comprising SEQ ID NO: 12. In some embodiments, at least one arm of the multispecific antibody, e.g., a bispecific antibody, comprises a light chain amino acid sequence comprising SEQ ID NO: 58.

In some embodiments, at least one arm of the multispecific antibody, e.g., a bispecific antibody, a heavy chain amino acid sequence comprising an amino acid sequence selected from the group consisting of SEQ ID NO: 46, 48, 50, 52, 54, and 56, and a light chain amino acid sequence comprising SEQ ID NO: 58.

In some embodiments, at least one arm of the multispecific antibody, e.g., a bispecific antibody, comprises a heavy chain amino acid sequence comprising an amino acid sequence selected from the group consisting of SEQ ID NO: 46, 48, 50, 52, 54, and 56, and a light chain amino acid sequence comprising SEQ ID NO: 12.

In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, at least one arm of the multispecific antibody, e.g., a bispecific antibody, comprises a light chain amino acid that is at least 90%, 91%, 92%, 93%, 94%, 95%, 96%, 97%, 98% or 99% identical to the amino acid sequence of SEQ ID NO: 58. In some embodiments, at least one arm of the multispecific antibody, e.g., a bispecific antibody, comprises a light chain amino acid that is at least 90%, 91%, 92%, 93%, 94%, 95%, 96%, 97%, 98% or 99% identical to the amino acid sequence of SEQ ID NO: 12. In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a light chain amino acid that is at least 90%, 91%, 92%, 93%, 94%, 95%, 96%, 97%, 98% or 99% identical to the amino acid sequence of SEQ ID NO: 58. In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a light chain amino acid that is at least 90%, 91%, 92%, 93%, 94%, 95%, 96%, 97%, 98% or 99% identical to the amino acid sequence of SEQ ID NO: 12.

In some embodiments, at least one arm of the multispecific antibody, e.g., a bispecific antibody, comprises the heavy chain amino acid sequence of SEQ ID NO: 46 and the light chain amino acid sequence of SEQ ID NO: 58. In some embodiments, at least one arm of the multispecific antibody, e.g., a bispecific antibody, comprises the heavy chain amino acid sequence of SEQ ID NO: 46 and the light chain amino acid sequence of SEQ ID NO: 12.

In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to the amino acid of SEQ ID NO: 46. In some embodiments, at least one arm of the multispecific antibody, e.g., a bispecific antibody, comprises a light chain amino acid that is at least 90%, 91%, 92%, 93%, 94%, 95%, 96%, 97%, 98% or 99% identical to the amino acid sequence of SEQ ID NO: 58. In some embodiments, at least one arm of the multispecific antibody, e.g., a bispecific antibody, comprises a light chain amino acid that is at least 90%, 91%, 92%, 93%, 94%, 95%, 96%, 97%, 98% or 99% identical to the amino acid sequence of SEQ ID NO: 12. In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to the amino acid sequence selected of SEQ ID NO: 46, and a light chain amino acid that is at least 90%, 91%, 92%, 93%, 94%, 95%, 96%, 97%, 98% or 99% identical to the amino acid sequence of SEQ ID NO: 58. In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to the amino acid sequence selected of SEQ ID NO: 46, and a light chain amino acid that is at least 90%, 91%, 92%, 93%, 94%, 95%, 96%, 97%, 98% or 99% identical to the amino acid sequence of SEQ ID NO: 12.

In some embodiments, at least one arm of the multispecific antibody, e.g., a bispecific antibody, comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 16; a VH CDR2 sequence shown in Table 16; a VH CDR3 sequence shown in Table 16; a VL CDR1 sequence shown in Table 16; a VL CDR2 sequence shown in Table 16; and a VL CDR3 sequence shown in Table 16.

In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 16; a VH CD2 sequence that includes a sequence that is at least 90%, 91%, 92%, 93%, 94%, 95%, 96%, 97%, 98%, 99% or more identical to a VH CDR2 sequence shown in Table 16; a VH CDR3 sequence that includes a sequence that is at least 90%, 91%, 92%, 93%, 94%, 95%, 96%, 97%, 98%, 99% or more identical to a VH CDR3 sequence shown in Table 16; a VL CDR1 sequence that includes a sequence that is at least 90%, 91%, 92%, 93%, 94%, 95%, 96%, 97%, 98%, 99% or more identical to a VL CDR1 sequence shown in Table 16; a VL CDR2 sequence that includes a sequence that is at least 90%, 91%, 92%, 93%, 94%, 95%, 96%, 97%, 98%, 99% or more identical to a VL CDR2 sequence shown in Table 16; and a VL CDR3 sequence that includes a sequence that is at least 90%, 91%, 92%, 93%, 94%, 95%, 96%, 97%, 98%, 99% or more identical to a VL CDR3 sequence shown in Table 16.

In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 16.

In some embodiments, at least one arm of the multispecific antibody, e.g., a bispecific antibody, comprises a heavy chain that comprise a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 16.

In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of the six CDR sequences (VH CDR1, VH CDR2, VH CDR3, VL CDR1, VL CDR2, and VL CDR3) shown in a single row in Table 16.

In some embodiments, at least one arm of the multispecific antibody, e.g., a bispecific antibody, comprises a heavy chain that comprise a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 16.

In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein the VH CDR2 sequence comprises SSIWRNGIVTVYADS (SEQ ID NO: 246). In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein the VH CDR3 sequence comprises WSAAFDY (SEQ ID NO: 235). In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein the VH CDR2 sequence comprises SSIWRNGIVTVYADS (SEQ ID NO: 246), and the VH CDR3 sequence comprises WSAAFDY (SEQ ID NO: 235).

In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein the combination comprises a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

The disclosure also provides activatable antibodies that include an antibody or antigen-binding fragment thereof that specifically binds PDL1 coupled to a masking moiety (MM), such that coupling of the MM reduces the ability of the antibody or antigen-binding fragment thereof to bind PDL1. In some embodiments, the MM is coupled via a sequence that includes a substrate for a protease, for example, a protease that is active in diseased tissue and/or a protease that is co-localized with PDL1 at a treatment site in a subject. The activatable anti-PDL1 antibodies provided herein, also referred to herein as anti-PDL1 activatable antibodies or PDL1 activatable antibodies, are stable in circulation, activated at intended sites of therapy and/or diagnosis but not in normal, e.g., healthy tissue or other tissue not targeted for treatment and/or diagnosis, and, when activated, exhibit binding to PDL1 that is at least comparable to the corresponding, unmodified antibody.

In some embodiments, the activatable antibody that, in an activated state, specifically binds to mammalian PDL1, includes an antibody or an antigen binding fragment thereof (AB) that specifically binds to mammalian PDL1; a masking moiety (MM) that inhibits the binding of the AB to mammalian PDL1 when the activatable antibody is in an uncleaved state; and a cleavable moiety (CM) coupled to the AB, wherein the CM is a polypeptide that functions as a substrate for a protease.

In some embodiments, the activatable antibody that, in an activated state, has one or more of the following characteristics: (a) specifically binds to mammalian PDL1; and (b) specifically blocks a natural ligand of PDL1 from binding to the mammalian PDL1, wherein the activatable antibody comprises: an antibody or an antigen binding fragment thereof (AB) that specifically binds to mammalian PDL1; a masking moiety (MM) that inhibits the binding of the AB to mammalian PDL1 when the activatable antibody is in an uncleaved state; and a cleavable moiety (CM) coupled to the AB, wherein the CM is a polypeptide that functions as a substrate for a protease.

In some embodiments, the activatable antibody in an uncleaved state specifically binds to the mammalian PDL1 with a dissociation constant less than or equal to 1 nM, less than or equal to 2 nM, less than or equal to 3 nM, less than or equal to 4 nM, less than or equal to 5 nM, less than or equal to 10 nM, less than or equal to 15 nM, less than or equal to 20 nM, and/or less than or equal to 25 nM.

In some embodiments, the activatable antibody in an uncleaved state specifically binds to the mammalian PDL1 with a dissociation constant greater than or equal to 1 nM, greater than or equal to 2 nM, greater than or equal to 3 nM, greater than or equal to 4 nM, greater than or equal to 5 nM, greater than or equal to 10 nM, greater than or equal to 15 nM, greater than or equal to 20 nM, and/or greater than or equal to 25 nM.

In some embodiments, the activatable antibody in an uncleaved state specifically binds to the mammalian PDL1 with a dissociation constant in the range of 1 to 2 nM, 1 to 5 nM, 1 to 10 nM, 1 to 15 nM, 1 to 20 nM, 1 to 25 nM, 2 nM to 5 nM, 2 nM to 10 nM, 2 nM to 15 nM, 2 to 20 nM, 2 to 25 nM, 5 nM to 10 nM, 5 nM to 15 nM, 5 to 20 nM, 5 to 25 nM, 10 nM to 15 nM, 10 to 20 nM, 10 to 25 nM, 15 to 20 nM, 15 to 25 nM, or 20 to 25 nM.

In some embodiments, the activatable antibody in an activated state specifically binds to the mammalian PDL1 with a dissociation constant is less than or equal to 0.01 nM, less than or equal to 0.05 nM, less than or equal to 0.1 nM, less than or equal to 0.2 nM, less than or equal to 0.3 nM, less than or equal to 0.4 nM, less than or equal to 0.5 nM, less than or equal to 0.75 nM, and less than or equal to 1 nM.

In some embodiments, the activatable antibody in an activated state specifically binds to the mammalian PDL1 with a dissociation constant in the range of 0.01 nM to 1 nM, 0.05 nM to 1 nM, 0.1 nM to 1 nM, 0.2 nM to 1 nM, 0.3 nM to 1 nM, 0.4 nM to 1 nM, 0.5 nM to 1 nM, 0.75 nM to 1 nM, 0.01 nM to 0.75 nM, 0.05 nM to 0.75 nM, 0.1 nM to 0.75 nM, 0.2 nM to 0.75 nM, 0.3 nM to 0.75 nM, 0.4 nM to 0.75 nM, 0.5 nM to 0.75 nM, 0.01 nM to 0.5 nM, 0.05 nM to 0.5 nM, 0.1 nM to 0.5 nM, 0.2 nM to 0.5 nM, 0.3 nM to 0.5 nM, 0.4 nM to 0.5 nM, 0.01 nM to 0.4 nM, 0.05 nM to 0.4 nM, 0.1 nM to 0.4 nM, 0.2 nM to 0.4 nM, 0.3 nM to 0.4 nM, 0.01 nM to 0.3 nM, 0.05 nM to 0.3 nM, 0.1 nM to 0.3 nM, 0.2 nM to 0.3 nM, 0.01 nM to 0.2 nM, 0.05 nM to 0.2 nM, 0.1 nM to 0.2 nM, 0.01 nM to 0.1 nM, 0.05 nM to 0.1 nM, or 0.01 nM to 0.05 nM.

In some embodiments, the AB specifically binds to the mammalian PDL1 with a dissociation constant is less than or equal to 0.01 nM, less than or equal to 0.05 nM, less than or equal to 0.1 nM, less than or equal to 0.2 nM, less than or equal to 0.3 nM, less than or equal to 0.4 nM, less than or equal to 0.5 nM, less than or equal to 0.75 nM, and less than or equal to 1 nM.

In some embodiments, the AB specifically binds to the mammalian PDL1 with a dissociation constant in the range of 0.01 nM to 1 nM, 0.05 nM to 1 nM, 0.1 nM to 1 nM, 0.2 nM to 1 nM, 0.3 nM to 1 nM, 0.4 nM to 1 nM, 0.5 nM to 1 nM, 0.75 nM to 1 nM, 0.01 nM to 0.75 nM, 0.05 nM to 0.75 nM, 0.1 nM to 0.75 nM, 0.2 nM to 0.75 nM, 0.3 nM to 0.75 nM, 0.4 nM to 0.75 nM, 0.5 nM to 0.75 nM, 0.01 nM to 0.5 nM, 0.05 nM to 0.5 nM, 0.1 nM to 0.5 nM, 0.2 nM to 0.5 nM, 0.3 nM to 0.5 nM, 0.4 nM to 0.5 nM, 0.01 nM to 0.4 nM, 0.05 nM to 0.4 nM, 0.1 nM to 0.4 nM, 0.2 nM to 0.4 nM, 0.3 nM to 0.4 nM, 0.01 nM to 0.3 nM, 0.05 nM to 0.3 nM, 0.1 nM to 0.3 nM, 0.2 nM to 0.3 nM, 0.01 nM to 0.2 nM, 0.05 nM to 0.2 nM, 0.1 nM to 0.2 nM, 0.01 nM to 0.1 nM, 0.05 nM to 0.1 nM, or 0.01 nM to 0.05 nM.

In some embodiments, the mammalian PDL1 is selected from the group consisting of a human PDL1, a murine PDL1, a rat PDL1, and a cynomolgus monkey PDL1. In some embodiments, the AB specifically binds to human PDL1, murine PDL1 or cynomolgus monkey PDL1 with a dissociation constant of less than 1 nM. In some embodiments, the mammalian PDL1 is a human PDL1.

In some embodiments, the AB has one or more of the following characteristics: (a) the AB specifically binds to human PDL1 and murine PDL1; (b) the AB specifically binds to human PDL1 and cynomolgus monkey PDL1; and (c) the AB specifically binds to human PDL1, murine PDL1, and cynomolgus monkey PDL1.

In some embodiments, the AB has one or more of the following characteristics: (a) the AB specifically binds human PDL1, murine PDL1, and cynomolgus monkey PDL1; (b) the AB inhibits binding of human B7-1 and human PD1 to human PDL1; (c) the AB inhibits binding of murine B7-1 and murine PD1 to murine PDL1; and (d) the AB inhibits binding of cynomolgus monkey B7-1 and cynomolgus monkey PD1 to cynomolgus monkey PDL1.

In some embodiments, the AB blocks the ability of a natural ligand to bind to the mammalian PDL1 with an $EC_{50}$ less than or equal to 0.5 nM, less than or equal to 1 nM, less than or equal to 2 nM, less than or equal to 3 nM, less than or equal to 4 nM, less than or equal to 5 nM, less than or equal to 6 nM, less than or equal to 7 nM, less than or equal to 8 nM, less than or equal to 9 nM, and/or less than or equal to 10 nM.

In some embodiments, the AB blocks the ability of a natural ligand to bind to the mammalian PDL1 with an $EC_{50}$ of 0.5 nM to 10 nM, 0.5 nM to 5 nM, 0.5 nM to 3 nM, 0.5 nM to 2 nM, 0.5 nM to 1 nM, 1 nM to 10 nM, 1 nM to 5 nM, 1 nM to 3 nM, 1 nM to 2 nM, 2 nM to 10 nM, 2 nM to 5 nM, 2 nM to 3 nM, 3 nM to 10 nM, 3 nM to 5 nM, or 5 nM to 10 nM.

In some embodiments, natural ligand is a mammalian PD1. In some embodiments, the natural ligand is selected from the group consisting of: a human PD1, a murine PD1, and a cynomolgus monkey PD1.

In some embodiments, the natural ligand is a mammalian B7-1. In some embodiments, the natural ligand is selected from the group consisting of: a human B7-1, a murine B7-1, and a cynomolgus monkey B7-1.

In some embodiments, the activatable antibody has one or more of the following characteristics (a) the AB induces type 1 diabetes in a non-obese diabetic (NOD) mouse; and (b) the activatable antibody in an uncleaved state inhibits the induction of type 1 diabetes in a NOD mouse.

In some embodiments, the activatable antibody inhibits the induction of type 1 diabetes in the NOD mouse after administration of the activatable antibody at a single dose of 0.1 mg/kg to 3 mg/kg, 0.5 mg/kg to 3 mg/kg, 1 mg/kg to 3 mg/kg, 2 mg/kg to 3 mg/kg, 0.1 mg/kg to 2 mg/kg, 0.5 mg/kg to 2 mg/kg, 1 mg/kg to 2 mg/kg, 0.1 mg/kg to 1 mg/kg, 0.5 mg/kg to 1 mg/kg, or 0.1 mg/kg to 0.5 mg/kg.

In some embodiments, the activatable antibody induces type 1 diabetes in a subject after administration of the activatable antibody at a single dose of 1 mg/kg. In some embodiments, the subject is a NOD mouse.

In some embodiments, the activatable antibody induces type 1 diabetes in a subject after administration of the activatable antibody at single dose less than or equal to 3 mg/kg, less than or equal to 2 mg/kg, less than or equal to 1 mg/kg, less than or equal to 0.5 mg/kg, and/or less than or equal to 0.1 mg/kg.

In some embodiments, the activatable antibody induces type 1 diabetes in a subject after administration of the activatable antibody at single dose in the range selected from the group consisting of 0.1 mg/kg to 3 mg/kg, 0.5 mg/kg to 3 mg/kg, 1 mg/kg to 3 mg/kg, 2 mg/kg to 3 mg/kg, 0.1 mg/kg to 2 mg/kg, 0.5 mg/kg to 2 mg/kg, 1 mg/kg to 2 mg/kg, 0.1 mg/kg to 1 mg/kg, 0.5 mg/kg to 1 mg/kg, and 0.1 mg/kg to 0.5 mg/kg. In some embodiments, the subject is a NOD mouse.

In some embodiments, the activatable antibody has one or more of the following characteristics (a) the activatable antibody in an uncleaved state does not induce type 1 diabetes in greater than 50% of a population of non-obese diabetic (NOD) mice, and the AB induces type 1 diabetes in greater than 50% of a population of NOD mice.

In some embodiments, the activatable antibody does not induce type 1 diabetes in greater than 50% of the population of NOD mice after administration to each mouse in the population a single dose less than or equal to 3 mg/kg, less than or equal to 2 mg/kg, less than or equal to 1 mg/kg, less than or equal to 0.5 mg/kg, and/or less than or equal to 0.1 mg/kg.

In some embodiments, the activatable antibody does not induce type 1 diabetes in greater than 50% of the population of NOD mice after administration to each mouse in the population a single dose of the activatable antibody at a dosage of: 0.1 mg/kg to 3 mg/kg, 0.5 mg/kg to 3 mg/kg, 1 mg/kg to 3 mg/kg, 2 mg/kg to 3 mg/kg, 0.1 mg/kg to 2 mg/kg, 0.5 mg/kg to 2 mg/kg, 1 mg/kg to 2 mg/kg, 0.1 mg/kg to 1 mg/kg, 0.5 mg/kg to 1 mg/kg, or 0.1 mg/kg to 0.5 mg/kg.

In some embodiments, the activatable antibody has one or more of the following characteristics (a) the activatable antibody in an uncleaved state does not induce type 1 diabetes in greater than 50% of a population of non-obese diabetic (NOD) mice when administered at a single dose of 1 mg/kg; and (b) the AB induces type 1 diabetes in greater than 50% of a population of NOD mice, when administered at a single dose of 1 mg/kg.

In some embodiments, the AB induces type 1 diabetes in greater than 50% of the population of the NOD mice after administration to each mouse in the population a single dose of the AB at a dosage less than or equal to 3 mg/kg, less than or equal to 2 mg/kg, less than or equal to 1 mg/kg, less than or equal to 0.5 mg/kg, and/or less than or equal to 0.1 mg/kg.

In some embodiments, the AB induces type 1 diabetes in greater than 50% of the population of the NOD mice after administration to each mouse in the population a single dose of the AB at a dosage of: 0.1 mg/kg to 3 mg/kg, 0.5 mg/kg to 3 mg/kg, 1 mg/kg to 3 mg/kg, 2 mg/kg to 3 mg/kg, 0.1 mg/kg to 2 mg/kg, 0.5 mg/kg to 2 mg/kg, 1 mg/kg to 2 mg/kg, 0.1 mg/kg to 1 mg/kg, 0.5 mg/kg to 1 mg/kg, or 0.1 mg/kg to 0.5 mg/kg.

In some embodiments, he NOD mouse is a female NOD/ShiLtJ mouse substrain.

In some embodiments, the activatable antibody inhibits the induction of type 1 diabetes in a NOD mouse by at least 3-fold compared to the AB.

In some embodiments, the activatable antibody exhibits a safety margin that is at least a three-fold safety margin relative to the AB.

In some embodiments, the activatable antibody in an uncleaved state binds to a smaller percentage of a population of peripheral blood CD4+CD8+T lymphocytes than does the AB.

In some embodiments, the activatable antibody does not bind to greater than 50% of the population of peripheral blood CD4+CD8+T lymphocytes after administration of a single dose of the activatable antibody at a dosage less than or equal to 5 mg/kg, less than or equal to 4 mg/kg, less than or equal to 3 mg/kg, less than or equal to 2 mg/kg, less than or equal to 1 mg/kg, less than or equal to 0.5 mg/kg, and/or less than or equal to 0.1 mg/kg.

In some embodiments, the activatable antibody does not bind to greater than 50% of the population of peripheral blood CD4+CD8+T lymphocytes after administration of a single dose of the activatable antibody at a dosage of: 0.1 mg/kg to 5 mg/kg, 0.5 mg/kg to 5 mg/kg, 1 mg/kg to 5 mg/kg, 2 mg/kg to 5 mg/kg, 3 mg/kg to 5 mg/kg, 0.1 mg/kg to 3 mg/kg, 0.5 mg/kg to 3 mg/kg, 1 mg/kg to 3 mg/kg, 2 mg/kg to 3 mg/kg, 0.1 mg/kg to 2 mg/kg, 0.5 mg/kg to 2 mg/kg, 1 mg/kg to 2 mg/kg, 0.1 mg/kg to 1 mg/kg, 0.5 mg/kg to 1 mg/kg, or 0.1 mg/kg to 0.5 mg/kg.

In some embodiments, the AB binds to greater than 50% of the population of peripheral blood CD4+CD8+T lymphocytes after administration of a single dose of the AB at a dosage of: 0.1 mg/kg to 5 mg/kg, 0.5 mg/kg to 5 mg/kg, 1 mg/kg to 5 mg/kg, 2 mg/kg to 5 mg/kg, 3 mg/kg to 5 mg/kg, 0.1 mg/kg to 3 mg/kg, 0.5 mg/kg to 3 mg/kg, 1 mg/kg to 3 mg/kg, 2 mg/kg to 3 mg/kg, 0.1 mg/kg to 2 mg/kg, 0.5 mg/kg to 2 mg/kg, 1 mg/kg to 2 mg/kg, 0.1 mg/kg to 1 mg/kg, 0.5 mg/kg to 1 mg/kg, or 0.1 mg/kg to 0.5 mg/kg.

In some embodiments, the peripheral blood CD4+CD8+T lymphocytes are murine. In some embodiments, the murine peripheral blood CD4+CD8+T lymphocytes are derived from a tumor-bearing mouse.

In some embodiments, the percentage of the population of peripheral blood CD4+CD8+T lymphocytes to which the AB binds is less than 60% when the activatable antibody is administered at a dose between 1 mg/kg and 5 mg/kg. In some embodiments, the percentage of the population of peripheral blood CD4+CD8+T lymphocytes to which the AB binds is less than 50% when the activatable antibody is administered at a dose between 1 mg/kg and 5 mg/kg. In some embodiments, the percentage of the population of peripheral blood CD4+CD8+T lymphocytes to which the AB binds is between 30 and 60% when the activatable antibody is administered at a dose between 1 mg/kg and 5 mg/kg. In some embodiments, the percentage of the population of peripheral blood CD4+CD8+T lymphocytes to which the AB binds is between 30 and 50% when the activatable antibody is administered at a dose between 1 mg/kg and 5 mg/kg.

The invention also provides methods of treating, preventing and/or delaying the onset or progression of, or alleviating a symptom associated with aberrant expression and/or activity of PDL1 in a subject using activatable antibodies that bind PDL1, particularly activatable antibodies that bind and neutralize or otherwise inhibit at least one biological activity of PDL1 and/or PDL1-mediated signaling.

The activatable antibodies in an activated state bind PDL1 and include (i) an antibody or an antigen binding fragment thereof (AB) that specifically binds to PDL1; (ii) a masking moiety (MM) that, when the activatable antibody is in an uncleaved state, inhibits the binding of the AB to PDL1; and (c) a cleavable moiety (CM) coupled to the AB, wherein the CM is a polypeptide that functions as a substrate for a protease.

In some embodiments, the activatable antibody in the uncleaved state has the structural arrangement from N-terminus to C-terminus as follows: MM-CM-AB or AB-CM-MM.

In some embodiments, the activatable antibody comprises a linking peptide between the MM and the CM.

In some embodiments, the activatable antibody comprises a linking peptide between the CM and the AB.

In some embodiments, the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM. In some embodiments, the two linking peptides need not be identical to each other.

In some embodiments, at least one of LP1 or LP2 comprises an amino acid sequence selected from the group consisting of $(GS)_n$, $(GGS)_n$, $(GSGGS)_n$ (SEQ ID NO: 191) and $(GGGS)_n$ (SEQ ID NO: 192), where n is an integer of at least one.

In some embodiments, at least one of LP1 or LP2 comprises an amino acid sequence selected from the group consisting of GGSG (SEQ ID NO: 193), GGSGG (SEQ ID NO: 194), GSGSG (SEQ ID NO: 195), GSGGG (SEQ ID NO: 196), GGGSG (SEQ ID NO: 197), and GSSSG (SEQ ID NO: 198).

In some embodiments, LP1 comprises the amino acid sequence GSSGGSGGSGGSG (SEQ ID NO: 199), GSSGGSGGSGG (SEQ ID NO: 200), GSSGGSGGSGGS (SEQ ID NO: 201), GSSGGSGGSGGSGGS (SEQ ID NO: 202), GSSGGSGGSG (SEQ ID NO: 203), or GSSGGSGGSGS (SEQ ID NO: 204).

In some embodiments, LP2 comprises the amino acid sequence GSS, GGS, GGGS (SEQ ID NO: 205), GSSGT (SEQ ID NO: 206) or GSSG (SEQ ID NO: 207).

In some embodiments, the AB has a dissociation constant of about 100 nM or less for binding to PDL1.

In some embodiments, the activatable antibody includes an antibody or antigen-binding fragment thereof (AB) that specifically binds PDL1. In some embodiments, the antibody or antigen binding fragment thereof that binds PDL1 is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, such an antibody or antigen binding fragment thereof that binds PDL1 is a mouse, other rodent, chimeric, humanized or fully human monoclonal antibody.

In some embodiments, the activatable antibody comprises a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, the activatable antibody comprises a light chain amino acid sequence comprising SEQ ID NO: 12 or SEQ ID NO: 58. In some embodiments, the activatable antibody comprises a light chain amino acid sequence comprising SEQ ID NO: 12. In some embodiments, the activatable antibody comprises a light chain amino acid sequence comprising SEQ ID NO: 58.

In some embodiments, the activatable antibody comprises a heavy chain amino acid sequence comprising an amino acid sequence selected from the group consisting of SEQ ID NO: 46, 48, 50, 52, 54, and 56, and a light chain amino acid sequence comprising SEQ ID NO: 58.

In some embodiments, the activatable antibody comprises a heavy chain amino acid sequence comprising an amino acid sequence selected from the group consisting of SEQ ID NO: 46, 48, 50, 52, 54, and 56, and a light chain amino acid sequence comprising SEQ ID NO: 12.

In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, the activatable antibody comprises a light chain amino acid that is at least 90%, 91%, 92%, 93%, 94%, 95%, 96%, 97%, 98% or 99% identical to the amino acid sequence of SEQ ID NO: 58. In some embodiments, the activatable antibody comprises a light chain amino acid that is at least 90%, 91%, 92%, 93%, 94%, 95%, 96%, 97%, 98% or 99% identical to the amino acid sequence of SEQ ID NO: 12. In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a light chain amino acid that is at least 90%, 91%, 92%, 93%, 94%, 95%, 96%, 97%, 98% or 99% identical to the amino acid sequence of SEQ ID NO: 58. In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a light chain amino acid that is at least 90%, 91%, 92%, 93%, 94%, 95%, 96%, 97%, 98% or 99% identical to the amino acid sequence of SEQ ID NO: 12.

In some embodiments, the AB of the activatable anti-PDL1 antibody comprises a heavy chain amino acid sequence selected from the group consisting of the heavy chain sequences shown in Table 15. In some embodiments, the AB of the activatable anti-PDL1 antibody comprises a light chain amino acid sequence selected from the group consisting of the light chain sequences shown in Table 15. In some embodiments, the AB of the activatable anti-PDL1 antibody comprises a heavy chain amino acid sequence selected from the group consisting of the heavy chain sequences shown in Table 15 and a light chain amino acid sequence selected from the group consisting of the light chain sequences shown in Table 15.

In some embodiments, the AB of the activatable anti-PDL1 antibody comprises a heavy chain amino acid sequence that is at least 90%, 91%, 92%, 93%, 94%, 95%, 96%, 97%, 98% or 99% identical to an amino acid sequence selected from the group consisting of the heavy chain sequences shown in Table 15. In some embodiments, the AB of the activatable anti-PDL1 antibody comprises a light chain amino acid sequence that is at least 90%, 91%, 92%, 93%, 94%, 95%, 96%, 97%, 98% or 99% identical to an amino acid sequence selected from the group consisting of the light chain sequences shown in Table 15. In some embodiments, the AB of the activatable anti-PDL1 antibody comprises a heavy chain amino acid sequence that is at least 90%, 91%, 92%, 93%, 94%, 95%, 96%, 97%, 98% or 99% identical to an amino acid sequence selected from the group consisting of the heavy chain sequences shown in Table 15 and a light chain amino acid sequence that is at least 90%, 91%, 92%, 93%, 94%, 95%, 96%, 97%, 98% or 99% identical to an amino acid sequence selected from the group consisting of the light chain sequences shown in Table 15.

In some embodiments, the activatable antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 16; a VH CDR2 sequence shown in Table 16; a VH CDR3 sequence shown in Table 16; a VL CDR1 sequence shown in Table 16; a VL CDR2 sequence shown in Table 16; and a VL CDR3 sequence shown in Table 16.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 16; a VH CD2 sequence that includes a sequence that is at least 90%, 91%, 92%, 93%, 94%, 95%, 96%, 97%, 98%, 99% or more identical to a VH CDR2 sequence shown in Table 16; a VH CDR3 sequence that includes a sequence that is at least 90%, 91%, 92%, 93%, 94%, 95%, 96%, 97%, 98%, 99% or more identical to a VH CDR3 sequence shown in Table 16; a VL CDR1 sequence that includes a sequence that is at least 90%, 91%, 92%, 93%, 94%, 95%, 96%, 97%, 98%, 99% or more identical to a VL CDR1 sequence shown in Table 16; a VL CDR2 sequence that includes a sequence that is at least 90%, 91%, 92%, 93%, 94%, 95%, 96%, 97%, 98%, 99% or more identical to a VL CDR2 sequence shown in Table 16; and a VL CDR3 sequence that includes a sequence that is at least 90%, 91%, 92%, 93%, 94%, 95%, 96%, 97%, 98%, 99% or more identical to a VL CDR3 sequence shown in Table 16.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 16.

In some embodiments, the activatable antibody comprises a heavy chain that comprise a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 16.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of the six CDR sequences (VH CDR1, VH CDR2, VH CDR3, VL CDR1, VL CDR2, and VL CDR3) shown in a single row in Table 16.

In some embodiments, the activatable antibody comprises a heavy chain that comprise a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 16.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the VH CDR2 sequence comprises SSIWRNGIVTVYADS (SEQ ID NO: 246). In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the VH CDR3 sequence comprises WSAAFDY (SEQ ID NO: 235). In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the VH CDR2 sequence comprises SSIWRNGIVTVYADS (SEQ ID NO: 246), and the VH CDR3 sequence comprises WSAAFDY (SEQ ID NO: 235).

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the combination comprises a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, the activatable antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 17; a VH CDR2 sequence shown in Table 17; a VH CDR3 sequence shown in Table 17; a VL CDR1 sequence shown in Table 17; a VL CDR2 sequence shown in Table 17; and a VL CDR3 sequence shown in Table 17.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 17; a VH CD2 sequence that includes a sequence that is at least 90%, 91%, 92%, 93%, 94%, 95%, 96%, 97%, 98%, 99% or more identical to a VH CDR2 sequence shown in Table 17; a VH CDR3 sequence that includes a sequence that is at least 90%, 91%, 92%, 93%, 94%, 95%, 96%, 97%, 98%, 99% or more identical to a VH CDR3 sequence shown in Table 17; a VL CDR1 sequence that includes a sequence that is at least 90%, 91%, 92%, 93%, 94%, 95%, 96%, 97%, 98%, 99% or more identical to a VL CDR1 sequence shown in Table 17; a VL CDR2 sequence that includes a sequence that is at least 90%, 91%, 92%, 93%, 94%, 95%, 96%, 97%, 98%, 99% or more identical to a VL CDR2 sequence shown in Table 17; and a VL CDR3 sequence that includes a sequence that is at least 90%, 91%, 92%, 93%, 94%, 95%, 96%, 97%, 98%, 99% or more identical to a VL CDR3 sequence shown in Table 17.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination shown in Table 17.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination shown in Table 17.

In some embodiments, the activatable antibody comprises an amino acid sequence selected from the group consisting of SEQ ID NOs: 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201. In some embodiments, the activatable antibody comprises an amino acid sequence selected from the group consisting of SEQ ID NO: 46, 48, 50, 52, 54, and 56. In some embodiments, the activatable antibody comprises an amino acid sequence selected from the group consisting of SEQ ID NOs: 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201, and an amino acid sequence selected from the group consisting of SEQ ID NO: 46, 48, 50, 52, 54, and 56.

In some embodiments, the activatable antibody comprises an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201. In some embodiments, the activatable antibody comprises an amino acid sequence selected from the group consisting of SEQ ID NO: 46, 48, 50, 52, 54, and 56. In some embodiments, the activatable antibody comprises an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201, and an amino acid sequence selected from the group consisting of SEQ ID NO: 46, 48, 50, 52, 54, and 56.

In some embodiments, the activatable antibody comprises an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, and 1201. In some embodiments, the activatable antibody comprises an amino acid sequence selected from the group consisting of SEQ ID NO: 46, 48, 50, 52, 54, and 56. In some embodiments, the activatable antibody comprises an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 100, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, and 1201, and an amino acid sequence selected from the group consisting of SEQ ID NO: 46, 48, 50, 52, 54, and 56.

In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201. In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56. In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201, and an amino acid that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56.

In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201. In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56. In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201, and an amino acid that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56.

In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1200, and 1201. In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56. In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, and 1201, and an amino acid that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56.

In some embodiments, the activatable antibody comprises an amino acid sequence selected from the group consisting of SEQ ID NOs: 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201, and the heavy chain amino acid sequence of SEQ ID NO: 46.

In some embodiments, the activatable antibody comprises an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201, and the heavy chain amino acid sequence of SEQ ID NO: 46.

In some embodiments, the activatable antibody comprises an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, and 1201, and the heavy chain amino acid sequence of SEQ ID NO: 46.

In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201, and an amino acid that is at least 90%, 91%, 92%, 93%, 94%, 95%, 96%, 97%, 98% or 99% identical to the heavy chain amino acid sequence of SEQ ID NO: 46.

In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201, and an amino acid that is at least 90%, 91%, 92%, 93%, 94%, 95%, 96%, 97%, 98% or 99% identical to the heavy chain amino acid sequence of SEQ ID NO: 46.

In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NOs: 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, and 1201, and an amino acid that is at least 90%, 91%, 92%, 93%, 94%, 95%, 96%, 97%, 98% or 99% identical to the heavy chain amino acid sequence of SEQ ID NO: 46.

In some embodiments, the activatable antibody comprises the amino acid sequence of SEQ ID NO: 428. In some embodiments, the activatable antibody comprises an amino acid sequence selected from the group consisting of SEQ ID NO: 430, 432, 434, and 1202. In some embodiments, the activatable antibody comprises the amino acid sequence of SEQ ID NO: 428, and an amino acid sequence selected from the group consisting of SEQ ID NO: 430, 432, and 434.

In some embodiments, the activatable antibody comprises the amino acid sequence of SEQ ID NO: 1008. In some embodiments, the activatable antibody comprises an amino acid sequence selected from the group consisting of SEQ ID NO: 430, 432, 434, and 1202. In some embodiments, the activatable antibody comprises the amino acid sequence of SEQ ID NO: 1008, and an amino acid sequence selected from the group consisting of SEQ ID NO: 430, 432, 434, and 1202.

In some embodiments, the activatable antibody includes an amino acid that is at least 90%, 91%, 92%, 93%, 94%, 95%, 96%, 97%, 98% or 99% identical to the amino acid sequence of SEQ ID NO: 428. In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NO: 430, 432, 434, and 1202. In some embodiments, the activatable antibody includes an amino acid that is at least 90%, 91%, 92%, 93%, 94%, 95%, 96%, 97%, 98% or 99% identical to the amino acid sequence of SEQ ID NO: 428, and an amino acid that is at least 90%, 91%, 92%, 93%, 94%, 95%, 96%, 97%, 98% or 99% identical to an amino acid sequence selected from the group consisting of SEQ ID NO: 430, 432, 434, and 1202.

In some embodiments, the activatable antibody includes an amino acid that is at least 90%, 91%, 92%, 93%, 94%, 95%, 96%, 97%, 98% or 99% identical to the amino acid sequence of SEQ ID NO: 1008. In some embodiments, the activatable antibody includes an amino acid that is at least 90%, 91%, 92%, 93%, 94%, 95%, 96%, 97%, 98% or 99% identical to an amino acid sequence selected from the group consisting of SEQ ID NO: 430, 432, 434, and 1202. In some embodiments, the activatable antibody includes an amino acid that is at least 90%, 91%, 92%, 93%, 94%, 95%, 96%, 97%, 98% or 99% identical to the amino acid sequence of SEQ ID NO: 1008, and an amino acid that is at least 90%, 91%, 92%, 93%, 94%, 95%, 96%, 97%, 98% or 99% identical to an amino acid sequence selected from the group consisting of SEQ ID NO: 430, 432, 434, and 1202.

In some embodiments, the activatable antibody comprises a masking moiety (MM) comprising an amino acid sequence selected from the group consisting of SEQ ID NOs: 59-81, 208, and 426; a cleavable moiety (CM) comprising an amino acid sequence selected from the group consisting of SEQ ID NOs: 341, 352, 359, 364, 372, 377, 379, 383, 394, 437, 883-893, 901-920, and 921; and a combination of a VH CDR1 sequence, a VH CDR2 sequence, a VH CDR3 sequence, a VL CDR1 sequence, a VL CDR2 sequence, and a VL CDR3 sequence, wherein the combination comprises a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, the activatable antibody comprises a masking moiety (MM) comprising an amino acid sequence selected from the group consisting of SEQ ID NOs: 60, 62, 63, 66-68, 71, 75, and 76; a cleavable moiety (CM) comprising an amino acid sequence selected from the group consisting of SEQ ID NOs: 341, 364, 377, 394, 437, 883-893, 901-911, and 920; and a combination of a VH CDR1 sequence, a VH CDR2 sequence, a VH CDR3 sequence, a VL CDR1 sequence, a VL CDR2 sequence, and a VL CDR3 sequence, wherein the combination comprises a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, the activatable antibody comprises a masking moiety (MM) comprising an amino acid sequence selected from the group consisting of SEQ ID NOs: 59-81, 208, and 426; a cleavable moiety (CM) comprising an amino acid sequence selected from the group consisting of SEQ ID NOs: 341, 352, 359, 364, 372, 377, 379, 383, 394, 437, 883-893, 901-920, and 921; and of a variable light chain comprising the amino acid sequence of SEQ ID NO: 58 and a variable heavy chain comprising the amino acid sequence of SEQ ID NO: 46.

In some embodiments, the activatable antibody comprises a masking moiety (MM) comprising an amino acid sequence selected from the group consisting of SEQ ID NOs: 60, 62, 63, 66-68, 71, 75, and 76; a cleavable moiety (CM) comprising an amino acid sequence selected from the group consisting of SEQ ID NOs: 341, 364, 377, 394, 437, 883-893, 901-911, and 920; and of a variable light chain comprising the amino acid sequence of SEQ ID NO: 58 and a variable heavy chain comprising the amino acid sequence of SEQ ID NO: 46.

In some embodiments, the activatable antibody comprises a masking moiety (MM) comprising an amino acid sequence selected from the group consisting of SEQ ID NOs: 59-81, 208, and 426; a cleavable moiety (CM) comprising an amino acid sequence selected from the group consisting of SEQ ID NOs: 341, 352, 359, 364, 372, 377, 379, 383, 394, 437, 883-893, 901-920, and 921; and of a variable light chain comprising the amino acid sequence of SEQ ID NO: 12 and a variable heavy chain comprising the amino acid sequence of SEQ ID NO: 46.

In some embodiments, the activatable antibody comprises a masking moiety (MM) comprising an amino acid sequence selected from the group consisting of SEQ ID NOs: 60, 62, 63, 66-68, 71, 75, and 76; a cleavable moiety (CM) comprising an amino acid sequence selected from the group consisting of SEQ ID NOs: 341, 364, 377, 394, 437, 883-893, 901-11, and 920; and of a variable light chain comprising the amino acid sequence of SEQ ID NO: 12 and a variable heavy chain comprising the amino acid sequence of SEQ ID NO: 46.

In some embodiments, the activatable antibody is encoded by a nucleic acid sequence that comprises a nucleic acid sequence encoding a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, the activatable antibody is encoded by a nucleic acid sequence that comprises a nucleic acid sequence encoding a heavy chain amino acid sequence selected from the group consisting of SEQ ID NO: 46, 48, 50, 52, 54, and 56. In some embodiments, the activatable antibody is encoded by a nucleic acid sequence that comprises a nucleic acid sequence encoding a light chain amino acid sequence comprising SEQ ID NO: 58. In some embodiments, the activatable antibody is encoded by a nucleic acid sequence that comprises a nucleic acid sequence encoding a light chain amino acid sequence comprising SEQ ID NO: 12. In some embodiments, the activatable antibody is encoded by a nucleic acid sequence that comprises a nucleic acid sequence encoding a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a nucleic acid sequence that comprises a nucleic acid sequence encoding a light chain amino acid sequence comprising SEQ ID NO: 58. In some embodiments, the activatable antibody is encoded by a nucleic acid sequence that comprises a nucleic acid sequence encoding a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a nucleic acid sequence that comprises a nucleic acid sequence encoding a light chain amino acid sequence comprising SEQ ID NO: 12. In some embodiments, the activatable antibody is encoded by a nucleic acid sequence that comprises a nucleic acid sequence encoding a heavy chain amino acid sequence selected from the group consisting of SEQ ID NO: 46, 48, 50, 52, 54, and 56, and a nucleic acid sequence that comprises a nucleic acid sequence encoding a light chain amino acid sequence comprising SEQ ID NO: 58. In some embodiments, the activatable antibody is encoded by a nucleic acid sequence that comprises a nucleic acid sequence encoding a heavy chain amino acid sequence selected from the group consisting of SEQ ID NO: 46, 48, 50, 52, 54, and 56, and a nucleic acid sequence that comprises a nucleic acid sequence encoding a light chain amino acid sequence comprising SEQ ID NO: 12.

In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56. In some embodiments, the activatable antibody is encoded by a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 58. In some embodiments, the activatable antibody is encoded by a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 12. In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 58. In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 12. In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 58. In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence of SEQ ID NO: 12.

In some embodiments, the activatable antibody is encoded by a heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55. In some embodiments, the activatable antibody is encoded by a heavy chain nucleic acid sequence selected from the group consisting of SEQ ID NO: 45, 47, 49, 51, 53, and 55. In some embodiments, the activatable antibody is encoded by the light chain nucleic acid sequence of SEQ ID NO: 57. In some embodiments, the activatable antibody is encoded by the light chain nucleic acid sequence of SEQ ID NO: 11. In some embodiments, the activatable antibody is encoded by heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55, and a light chain nucleic acid sequence comprising SEQ ID NO: 57. In some embodiments, the activatable antibody is encoded by heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55, and a light chain nucleic acid sequence comprising SEQ ID NO: 11. In some embodiments, the activatable antibody is encoded by a nucleic acid sequence that comprises a heavy chain nucleic acid sequence selected from the group consisting of SEQ ID NO: 45, 47, 49, 51, 53, and 55, and a light chain nucleic acid sequence comprising SEQ ID NO: 57. In some embodiments, the activatable antibody is encoded by a nucleic acid sequence that comprises a heavy chain nucleic acid sequence selected from the group consisting of SEQ ID NO: 45, 47, 49, 51, 53, and 55, and a light chain nucleic acid sequence comprising SEQ ID NO: 11.

In some embodiments, the activatable antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55. In some embodiments, the activatable antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 45, 47, 49, 51, 53, and 55. In some embodiments, the activatable antibody is encoded by a nucleic acid sequence that is at least 90%, 91%, 92%, 93%, 94%, 95%, 96%, 97%, 98% or 99% identical to the light chain nucleic acid sequence of SEQ ID NO: 57. In some embodiments, the activatable antibody is encoded by a nucleic acid sequence that is at least 90%, 91%, 92%, 93%, 94%, 95%, 96%, 97%, 98% or 99% identical to the light chain nucleic acid sequence of SEQ ID NO: 11. In some embodiments, the activatable antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55, and a nucleic acid sequence that is at least 90%, 91%, 92%, 93%, 94%, 95%, 96%, 97%, 98% or 99% identical to the light chain nucleic acid sequence comprising SEQ ID NO: 57. In some embodiments, the activatable antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 13, 15, 17, 21, 23, 25, 27, 29, 31, 33, 35, 37, 39, 41, 43, 45, 47, 49, 51, 53, and 55, and a nucleic acid sequence that is at least 90%, 91%, 92%, 93%, 94%, 95%, 96%, 97%, 98% or 99% identical to the light chain nucleic acid sequence comprising SEQ ID NO: 11. In some embodiments, the activatable antibody is encoded by a nucleic acid sequence that comprises a nucleic acid sequence that is at least 90%, 91%, 92%, 93%, 94%, 95%, 96%, 97%, 98% or 99% identical to heavy chain nucleic acid sequence selected from the group consisting of SEQ ID NO: 45, 47, 49, 51, 53, and 55, and a nucleic acid sequence that is at least 90%, 91%, 92%, 93%, 94%, 95%, 96%, 97%, 98% or 99% identical to light chain nucleic acid sequence comprising SEQ ID NO: 57. In some embodiments, the activatable antibody is encoded by a nucleic acid sequence that comprises a nucleic acid sequence that is at least 90%, 91%, 92%, 93%, 94%, 95%, 96%, 97%, 98% or 99% identical to heavy chain nucleic acid sequence selected from the group consisting of SEQ ID NO: 45, 47, 49, 51, 53, and 55, and a nucleic acid sequence that is at least 90%, 91%, 92%, 93%, 94%, 95%, 96%, 97%, 98% or 99% identical to light chain nucleic acid sequence comprising SEQ ID NO: 11.

In some embodiments, the MM has a dissociation constant for binding to the/M3 that is greater than the dissociation constant of the AB to PDL1.

In some embodiments, the MM has a dissociation constant for binding to the/M3 that is no more than the dissociation constant of the AB to PDL1.

In some embodiments, the MM has a dissociation constant for binding to the AB that is less than the dissociation constant of the AB to PDL1.

In some embodiments, the MM has a dissociation constant for binding to the AB that is approximately equal to the dissociation constant of the AB to PDL1.

In some embodiments, the MM does not interfere or compete with the AB for binding to PDL1 when the activatable antibody is in a cleaved state.

In some embodiments, the MM is a polypeptide of about 2 to 40 amino acids in length. In some embodiments, the MM is a polypeptide of up to about 40 amino acids in length.

In some embodiments, the MM polypeptide sequence is different from that of PDL1. In some embodiments, the MM polypeptide sequence is no more than 50% identical to any natural binding partner of the AB. In some embodiments, the MM polypeptide sequence is different from that of PDL1 and is no more than 40%, 30%, 25%, 20%, 15%, or 10% identical to any natural binding partner of the AB.

In some embodiments, the MM comprises an amino acid sequence selected from the group consisting of SEQ ID NOs: 59-81, 208, and 426. In some embodiments, the MM comprises an amino acid sequence that is at least 90%, 91%, 92%, 93%, 94%, 95%, 96%, 97%, 98% or 99% identical to an amino acid sequence selected from the group consisting of SEQ ID NOs: 59-81, 208, and 426.

In some embodiments, the coupling of the MM to the AB reduces the ability of the AB to bind PDL1 such that the dissociation constant ($K_d$) of the AB when coupled to the MM towards PDL1 is at least two times greater than the $K_d$ of the AB when not coupled to the MM towards PDL1.

In some embodiments, the coupling of the MM to the AB reduces the ability of the AB to bind PDL1 such that the dissociation constant ($K_d$) of the AB when coupled to the MM towards PDL1 is at least five times greater than the $K_d$ of the AB when not coupled to the MM towards PDL1.

In some embodiments, the coupling of the MM to the AB reduces the ability of the AB to bind PDL1 such that the dissociation constant ($K_d$) of the AB when coupled to the MM towards PDL1 is at least 10 times greater than the $K_d$ of the AB when not coupled to the MM towards PDL1.

In some embodiments, the coupling of the MM to the AB reduces the ability of the AB to bind PDL1 such that the dissociation constant ($K_d$) of the AB when coupled to the MM towards PDL1 is at least 20 times greater than the $K_d$ of the AB when not coupled to the MM towards PDL1.

In some embodiments, the coupling of the MM to the AB reduces the ability of the AB to bind PDL1 such that the dissociation constant ($K_d$) of the AB when coupled to the MM towards PDL1 is at least 40 times greater than the $K_d$ of the AB when not coupled to the MM towards PDL1.

In some embodiments, the coupling of the MM to the AB reduces the ability of the AB to bind PDL1 such that the dissociation constant ($K_d$) of the AB when coupled to the MM towards PDL1 is at least 100 times greater than the $K_d$ of the AB when not coupled to the MM towards PDL1.

In some embodiments, the coupling of the MM to the AB reduces the ability of the AB to bind PDL1 such that the dissociation constant ($K_d$) of the AB when coupled to the MM towards PDL1 is at least 1000 times greater than the $K_d$ of the AB when not coupled to the MM towards PDL1.

In some embodiments, the coupling of the MM to the AB reduces the ability of the AB to bind PDL1 such that the dissociation constant ($K_d$) of the AB when coupled to the MM towards PDL1 is at least 10,000 times greater than the $K_d$ of the AB when not coupled to the MM towards PDL1.

In some embodiments, in the presence of PDL1, the MM reduces the ability of the AB to bind PDL1 by at least 90% when the CM is uncleaved, as compared to when the CM is cleaved when assayed in vitro using a target displacement assay such as, for example, the assay described in PCT Publication No. WO 2010/081173, the contents of which are hereby incorporated by reference in their entirety.

In some embodiments, the protease that cleaves the CM is active, e.g., up-regulated, in diseased tissue, and the protease cleaves the CM in the activatable antibody when the activatable antibody is exposed to the protease.

In some embodiments, the protease is co-localized with PDL1 in a tissue, and the protease cleaves the CM in the activatable antibody when the activatable antibody is exposed to the protease.

In some embodiments, the protease is present at relatively higher levels in or in close proximity to target-containing tissue of a treatment site or diagnostic site than in tissue of non-treatment sites (for example in healthy tissue), and the protease cleaves the CM in the activatable antibody when the activatable antibody is exposed to the protease.

In some embodiments, the CM is positioned in the activatable antibody such that when the activatable antibody is in the uncleaved state, binding of the activatable antibody to PDL1 is reduced to occur with a dissociation constant that is at least twofold greater than the dissociation constant of an unmodified AB binding to PDL1, whereas in the cleaved state (i.e., when the activatable antibody is in the cleaved state), the AB binds PDL1.

In some embodiments, the CM is positioned in the activatable antibody such that when the activatable antibody is in the uncleaved state, binding of the activatable antibody to PDL1 is reduced to occur with a dissociation constant that is at least fivefold greater than the dissociation constant of an unmodified AB binding to PDL1, whereas in the cleaved state (i.e., when the activatable antibody is in the cleaved state), the AB binds PDL1.

In some embodiments, the CM is positioned in the activatable antibody such that when the activatable antibody is in the uncleaved state, binding of the activatable antibody to PDL1 is reduced to occur with a dissociation constant that is at least 10-fold greater than the dissociation constant of an unmodified AB binding to PDL1, whereas in the cleaved state (i.e., when the activatable antibody is in the cleaved state), the AB binds PDL1.

In some embodiments, the CM is positioned in the activatable antibody such that when the activatable antibody is in the uncleaved state, binding of the activatable antibody to PDL1 is reduced to occur with a dissociation constant that is at least 20-fold greater than the dissociation constant of an unmodified AB binding to PDL1, whereas in the cleaved state (i.e., when the activatable antibody is in the cleaved state), the AB binds PDL1.

In some embodiments, the CM is positioned in the activatable antibody such that when the activatable antibody is in the uncleaved state, binding of the activatable antibody to PDL1 is reduced to occur with a dissociation constant that is at least 40-fold greater than the dissociation constant of an unmodified AB binding to PDL1, whereas in the cleaved state, the AB binds PDL1.

In some embodiments, the CM is positioned in the activatable antibody such that when the activatable antibody is in the uncleaved state, binding of the activatable antibody to PDL1 is reduced to occur with a dissociation constant that is at least 50-fold greater than the dissociation constant of an unmodified AB binding to PDL1, whereas in the cleaved state, the AB binds PDL1.

In some embodiments, the CM is positioned in the activatable antibody such that when the activatable antibody is in the uncleaved state, binding of the activatable antibody to PDL1 is reduced to occur with a dissociation constant that is at least 100-fold greater than the dissociation constant of an unmodified AB binding to PDL1, whereas in the cleaved state, the AB binds PDL1.

In some embodiments, the CM is positioned in the activatable antibody such that when the activatable antibody is in the uncleaved state, binding of the activatable antibody to PDL1 is reduced to occur with a dissociation constant that is at least 200-fold greater than the dissociation constant of an unmodified AB binding to PDL1, whereas in the cleaved state, the AB binds PDL1.

In some embodiments, the CM is a polypeptide of up to 15 amino acids in length.

In some embodiments, the CM is a polypeptide that includes a first cleavable moiety (CM1) that is a substrate for at least one matrix metalloprotease (MMP) and a second cleavable moiety (CM2) that is a substrate for at least one serine protease (SP). In some embodiments, each of the CM1 substrate sequence and the CM2 substrate sequence of the CM1-CM2 substrate is independently a polypeptide of up to 15 amino acids in length.

In some embodiments, the CM is a substrate for at least one protease that is or is believed to be up-regulated in cancer. In some embodiments, the CM is a substrate for at least one protease that is or is believed to be up-regulated in inflammation. In some embodiments, the CM is a substrate for at least one protease that is or is believed to be up-regulated in autoimmunity.

In some embodiments, the CM is a substrate for at least one protease selected from the group consisting of a matrix metalloprotease (MMP), a thrombin, a neutrophil elastase, a cysteine protease, a legumain, and a serine protease, such as a matriptase (MT-SP1), and a urokinase (uPA). Without being bound by theory, it is believed that these proteases are up-regulated in at least one of cancer, inflammation, and/or autoimmunity.

Exemplary substrates include but are not limited to substrates cleavable by one or more of the following enzymes or proteases listed in Table 12.

In some embodiments, the CM is selected for use with a specific protease, for example a protease that is known to be co-localized with the target of the activatable antibody.

In some embodiments, the CM is selected for use with a specific protease, for example a protease that is known to be in close proximity to the target of the activatable antibody.

In some embodiments, the CM is a substrate for at least one MMP. Examples of MMPs include the MMPs listed in the Table 12. In some embodiments, the CM is a substrate for a protease selected from the group consisting of MMP9, MMP14, MMP1, MMP3, MMP13, MMP17, MMP11, and MMP19. In some embodiments the CM is a substrate for MMP9. In some embodiments, the CM is a substrate for MMP14.

In some embodiments, the CM is a substrate that includes the sequence TGRGPSWV (SEQ ID NO: 338); SARGPSRW (SEQ ID NO: 339); TARGPSFK (SEQ ID NO: 340); LSGRSDNH (SEQ ID NO: 341); GGWHTGRN (SEQ ID NO: 342); HTGRSGAL (SEQ ID NO: 343); PLTGRSGG (SEQ ID NO: 344); AARGPAIH (SEQ ID NO: 345); RGPAFNPM (SEQ ID NO: 346); SSRGPAYL (SEQ ID NO: 347); RGPATPIM (SEQ ID NO: 348); RGPA (SEQ ID NO: 349); GGQPSGMWGW (SEQ ID NO: 350); FPRPLGITGL (SEQ ID NO: 351); VHIVIPLGFLGP (SEQ ID NO: 352); SPLTGRSG (SEQ ID NO: 353); SAGFSLPA (SEQ ID NO: 354); LAPLGLQRR (SEQ ID NO: 355); SGGPLGVR (SEQ ID NO: 356); PLGL (SEQ ID NO: 357); LSGRSGNH (SEQ ID NO: 883); SGRSANPRG (SEQ ID NO: 884); LSGRSDDH (SEQ ID NO: 885); LSGRSDIH (SEQ ID NO: 886); LSGRSDQH (SEQ ID NO: 887); LSGRSDTH (SEQ ID NO: 888); LSGRSDNH (SEQ ID NO: 889); LSGRSDNP (SEQ ID NO: 890); LSGRSANP (SEQ ID NO: 891); LSGRSANI (SEQ ID NO: 892); and/or LSGRSDNI (SEQ ID NO: 893).

In some embodiments, the CM comprises the amino acid sequence LSGRSDNH (SEQ ID NO: 341). In some embodiments, the CM comprises the amino acid sequence TGRGPSWV (SEQ ID NO: 338). In some embodiments, the CM comprises the amino acid sequence PLTGRSGG (SEQ ID NO: 344). In some embodiments, the CM comprises the amino acid sequence GGQPSGMWGW (SEQ ID NO: 350). In some embodiments, the CM comprises the amino acid sequence FPRPLGITGL (SEQ ID NO: 351). In some embodiments, the CM comprises the amino acid sequence VHMPLGFLGP (SEQ ID NO: 352). In some embodiments, the CM comprises the amino acid sequence PLGL (SEQ ID NO: 357). In some embodiments, the CM comprises the amino acid sequence SARGPSRW (SEQ ID NO: 339). In some embodiments, the CM comprises the amino acid sequence TARGPSFK (SEQ ID NO: 340). In some embodiments, the CM comprises the amino acid sequence GGWHTGRN (SEQ ID NO: 342). In some embodiments, the CM comprises the amino acid sequence HTGRSGAL (SEQ ID NO: 343). In some embodiments, the CM comprises the amino acid sequence AARGPAIH (SEQ ID NO: 345). In some embodiments, the CM comprises the amino acid sequence RGPAFNPM (SEQ ID NO: 346). In some embodiments, the CM comprises the amino acid sequence SSRGPAYL (SEQ ID NO: 347). In some embodiments, the CM comprises the amino acid sequence RGPATPIM (SEQ ID NO: 348). In some embodiments, the CM comprises the amino acid sequence RGPA (SEQ ID NO: 349). In some embodiments, the CM comprises the amino acid sequence LSGRSGNH (SEQ ID NO: 883). In some embodiments, the CM comprises the amino acid sequence SGRSANPRG (SEQ ID NO: 884). In some embodiments, the CM comprises the amino acid sequence LSGRSDDH (SEQ ID NO: 885). In some embodiments, the CM comprises the amino acid sequence LSGRSDIH (SEQ ID NO: 886). In some embodiments, the CM comprises the amino acid sequence LSGRSDQH (SEQ ID NO: 887). In some embodiments, the CM comprises the amino acid sequence LSGRSDTH (SEQ ID NO: 888). In some embodiments, the CM comprises the amino acid sequence LSGRSDDH (SEQ ID NO: 889). In some embodiments, the CM comprises the amino acid sequence LSGRSDNP (SEQ ID NO: 890). In some embodiments, the CM comprises the amino acid sequence LSGRSANP (SEQ ID NO: 891). In some embodiments, the CM comprises the amino acid sequence LSGRSANI (SEQ ID NO: 892). In some embodiments, the CM comprises the amino acid sequence LSGRSDNI (SEQ ID NO: 893)

In some embodiments, the CM is a substrate for an MMP and includes the sequence ISSGLSS (SEQ ID NO: 358); QNQALRMA (SEQ ID NO: 359); AQNLLGMV (SEQ ID NO: 360); STFPFGMF (SEQ ID NO: 361); PVGYTSSL (SEQ ID NO: 362); DWLYWPGI (SEQ ID NO: 363), ISSGLLSS (SEQ ID NO: 364), LKAAPRWA (SEQ ID NO: 365); GPSHLVLT (SEQ ID NO: 366); LPGGLSPW (SEQ ID NO: 367); MGLFSEAG (SEQ ID NO: 368); SPLPLRVP (SEQ ID NO: 369); RMHLRSLG (SEQ ID NO: 370); LAAPLGLL (SEQ ID NO: 371); AVGLLAPP (SEQ ID NO: 372); LLAPSHRA (SEQ ID NO: 373); PAGLWLDP (SEQ ID NO: 374); MIAPVAYR (SEQ ID NO: 894); RPSPMWAY (SEQ ID NO: 895); WATPRPMR (SEQ ID NO: 896); FRLLDWQW (SEQ ID NO: 897); ISSGL (SEQ ID NO: 898); ISSGLLS (SEQ ID NO: 899); and/or ISSGLL (SEQ ID NO: 900).

In some embodiments, the CM comprises the amino acid sequence ISSGLSS (SEQ ID NO: 358). In some embodiments, the CM comprises the amino acid sequence QNQALRMA (SEQ ID NO: 359). In some embodiments, the CM comprises the amino acid sequence AQNLLGMV (SEQ ID NO: 360). In some embodiments, the CM comprises the amino acid sequence STFPFGMF (SEQ ID NO: 361). In some embodiments, the CM comprises the amino acid sequence PVGYTSSL (SEQ ID NO: 362). In some embodiments, the CM comprises the amino acid sequence DWLYWPGI (SEQ ID NO: 363). In some embodiments, the CM comprises the amino acid sequence ISSGLLSS (SEQ ID NO: 364). In some embodiments, the CM comprises the amino acid sequence LKAAPRWA (SEQ ID NO: 365). In some embodiments, the CM comprises the amino acid sequence GPSHLVLT (SEQ ID NO: 366). In some embodiments, the CM comprises the amino acid sequence LPGGLSPW (SEQ ID NO: 367). In some embodiments, the CM comprises the amino acid sequence MGLFSEAG (SEQ ID NO: 368). In some embodiments, the CM comprises the amino acid sequence SPLPLRVP (SEQ ID NO: 369). In some embodiments, the CM comprises the amino acid sequence RMHLRSLG (SEQ ID NO: 370). In some embodiments, the CM comprises the amino acid sequence LAAPLGLL (SEQ ID NO: 371). In some embodiments, the CM comprises the amino acid sequence AVGLLAPP (SEQ ID NO: 372). In some embodiments, the CM comprises the amino acid sequence LLAPSHRA (SEQ ID NO: 373). In some embodiments, the CM comprises the amino acid sequence PAGLWLDP (SEQ ID NO: 374). In some embodiments, the CM comprises the amino acid sequence MIAPVAYR (SEQ ID NO: 894). In some embodiments, the CM comprises the amino acid sequence RPSPMWAY (SEQ ID NO: 895). In some embodiments, the CM comprises the amino acid sequence WATPRPMR (SEQ ID NO: 896). In some embodiments, the CM comprises the amino acid sequence FRLLDWQW (SEQ ID NO: 897). In some embodiments, the CM comprises the amino acid sequence ISSGL (SEQ ID NO: 898). In some embodiments, the CM comprises the amino acid sequence ISSGLLS (SEQ ID NO: 899). In some embodiments, the CM comprises the amino acid sequence ISSGLL (SEQ ID NO: 900).

In some embodiments, the CM is a substrate for thrombin. In some embodiments, the CM is a substrate for thrombin and includes the sequence GPRSFGL (SEQ ID NO: 375) or GPRSFG (SEQ ID NO: 376). In some embodiments, the CM comprises the amino acid sequence GPRSFGL (SEQ ID NO: 375). In some embodiments, the CM comprises the amino acid sequence GPRSFG (SEQ ID NO: 376).

In some embodiments, the CM comprises an amino acid sequence selected from the group consisting of NTLSGRSENHSG (SEQ ID NO: 435); NTLSGRSGNHGS (SEQ ID NO: 436); TSTSGRSANPRG (SEQ ID NO: 437); TSGRSANP (SEQ ID NO: 438); VAGRSMRP (SEQ ID NO: 439); VVPEGRRS (SEQ ID NO: 440); ILPRSPAF (SEQ ID NO: 441); MVLGRSLL (SEQ ID NO: 442); QGRAITFI (SEQ ID NO: 443); SPRSIMLA (SEQ ID NO: 444); and SMLRSMPL (SEQ ID NO: 445).

In some embodiments, the CM comprises the amino acid sequence NTLSGRSENHSG (SEQ ID NO: 435). In some embodiments, the CM comprises the amino acid sequence NTLSGRSGNHGS (SEQ ID NO: 436). In some embodiments, the CM comprises the amino acid sequence TSTSGRSANPRG (SEQ ID NO: 437). In some embodiments, the CM comprises the amino acid sequence TSGRSANP (SEQ ID NO: 438). In some embodiments, the CM comprises the amino acid sequence VAGRSMRP (SEQ ID NO: 439). In some embodiments, the CM comprises the amino acid sequence VVPEGRRS (SEQ ID NO: 440). In some embodiments, the CM comprises the amino acid sequence ILPR-SPAF (SEQ ID NO: 441). In some embodiments, the CM comprises the amino acid sequence MVLGRSLL (SEQ ID NO: 442). In some embodiments, the CM comprises the amino acid sequence QGRAITFI (SEQ ID NO: 443). In some embodiments, the CM comprises the amino acid sequence SPRSIMLA (SEQ ID NO: 444). In some embodiments, the CM comprises the amino acid sequence SMLRSMPL (SEQ ID NO: 445).

In some embodiments, the CM is a substrate for a neutrophil elastase. In some embodiments, the CM is a substrate for a serine protease. In some embodiments, the CM is a substrate for uPA. In some embodiments, the CM is a substrate for legumain. In some embodiments, the CM is a substrate for matriptase. In some embodiments, the CM is a substrate for a cysteine protease. In some embodiments, the CM is a substrate for a cysteine protease, such as a cathepsin.

In some embodiments, the CM is a CM1-CM2 substrate and includes the sequence ISSGLLSGRSDNH (SEQ ID NO: 377); ISSGLLSSGGSGGSLSGRSDNH (SEQ ID NO: 378); AVGLLAPPGGTSTSGRSANPRG (SEQ ID NO: 379); TSTSGRSANPRGGGAVGLLAPP (SEQ ID NO: 380); VHMPLGFLGPGGTSTSGRSANPRG (SEQ ID NO: 381); TSTSGRSANPRGGGVHMPLGFLGP (SEQ ID NO: 382); AVGLLAPPGGLSGRSDNH (SEQ ID NO: 383); LSGRSDNHGGAVGLLAPP (SEQ ID NO: 384); VHMPLGFLGPGGLSGRSDNH (SEQ ID NO: 385); LSGRSDNHGGVHMPLGFLGP (SEQ ID NO: 386); LSGRSDNHGGSGGSISSGLLSS (SEQ ID NO: 387); LSGRSGNHGGSGGSISSGLLSS (SEQ ID NO: 388); ISSGLLSSGGSGGSLSGRSGNH (SEQ ID NO: 389); LSGRSDNHGGSGGSQNQALRMA (SEQ ID NO: 390); QNQALRMAGGSGGSLSGRSDNH (SEQ ID NO: 391); LSGRSGNHGGSGGSQNQALRMA (SEQ ID NO: 392); QNQALRMAGGSGGSLSGRSGNH (SEQ ID NO: 393); ISSGLLSGRSGNH (SEQ ID NO: 394); ISSGLLSGRSANPRG (SEQ ID NO: 901); AVGLLAPPTSGRSANPRG (SEQ ID NO: 902); AVGLLAPPSGRSANPRG (SEQ ID NO: 903); ISSGLLSGRSDDH (SEQ ID NO: 904); ISSGLLSGRSDIH (SEQ ID NO: 905); ISSGLLSGRSDQH (SEQ ID NO: 906); ISSGLLSGRSDTH (SEQ ID NO: 907); ISSGLLSGRSDNH (SEQ ID NO: 908); ISSGLLSGRSDNP (SEQ ID NO: 909); ISSGLLSGRSANP (SEQ ID NO: 910); ISSGLLSGRSANI (SEQ ID NO: 911); AVGLLAPPGGLSGRSDDH (SEQ ID NO: 912); AVGLLAPPGGLSGRSDIH (SEQ ID NO: 913); AVGLLAPPGGLSGRSDQH (SEQ ID NO: 914); AVGLLAPPGGLSGRSDTH (SEQ ID NO: 915); AVGLLAPPGGLSGRSDDH (SEQ ID NO: 916); AVGLLAPPGGLSGRSDNP (SEQ ID NO: 917); AVGLLAPPGGLSGRSANP (SEQ ID NO: 918); AVGLLAPPGGLSGRSANI (SEQ ID NO: 919); ISSGLLSGRSDNI (SEQ ID NO: 920); AVGLLAPPGGLSGRSDNI (SEQ ID NO: 921); GLSGRSDNHGGAVGLLAPP (SEQ ID NO: 1009); and/or GLSGRSDNHGGVHMPLGFLGP (SEQ ID NO: 1010).

In some embodiments, the CM1-CM2 substrate includes the sequence ISSGLLSGRSDNH (SEQ ID NO: 377), which is also referred to herein as substrate 2001. In some embodiments, the CM1-CM2 substrate includes the sequence ISSGLLSSGGSGGSLSGRSDNH (SEQ ID NO: 378), which is also referred to herein as substrate 1001/LP'/0001, where LP' as used in this CM1-CM2 substrate is the amino acid sequence GGSGGS (SEQ ID NO: 922). In some embodiments, the CM1-CM2 substrate includes the sequence AVGLLAPPGGTSTSGRSANPRG (SEQ ID NO: 379), which is also referred to herein as substrate 2015 and/or substrate 1004/LP'/0003, where LP' as used in this CM1-CM2 substrate is the amino acid sequence GG. In some embodiments, the CM1-CM2 substrate includes the sequence TSTSGRSANPRGGGAVGLLAPP (SEQ ID NO: 380), which is also referred to herein as substrate 0003/LP'/1004, where LP' as used in this CM1-CM2 substrate is the amino acid sequence GG. In some embodiments, the CM1-CM2 substrate includes the sequence VHIVIPLGFLGPG-GTSTSGRSANPRG (SEQ ID NO: 381), which is also referred to herein as substrate 1003/LP'/0003, where LP' as used in this CM1-CM2 substrate is the amino acid sequence GG. In some embodiments, the CM1-CM2 substrate includes the sequence TSTSGRSANPRGGGVHMPLGFLGP (SEQ ID NO: 382), which is also referred to herein as substrate 0003/LP'/1003, where LP' as used in this CM1-CM2 substrate is the amino acid sequence GG. In some embodiments, the CM1-CM2 substrate includes the sequence AVGLLAPPGGLSGRSDNH (SEQ ID NO: 383), which is also referred to herein as substrate 3001 and/or substrate 1004/LP'/0001, where LP' as used in this CM1-CM2 substrate is the amino acid sequence GG. In some embodiments, the CM1-CM2 substrate includes the sequence LSGRSDNHGGAVGLLAPP (SEQ ID NO: 384), which is also referred to herein as substrate 0001/LP'/1004, where LP' as used in this CM1-CM2 substrate is the amino acid sequence GG. In some embodiments, the CM1-CM2 substrate includes the sequence VHMPLGFLGPGGLSGRSDNH (SEQ ID NO: 385), which is also referred to herein as substrate 1003/LP'/0001, wherein LP' as used in this CM1-CM2 substrate is the amino acid sequence GG. In some embodiments, the CM1-CM2 substrate includes the sequence LSGRSDNHGGVHMPLGFLGP (SEQ ID NO: 386), which is also referred to herein as substrate 0001/LP'/1003, where LP' as used in this CM1-CM2 substrate is the amino acid sequence GG. In some embodiments, the CM1-CM2 substrate includes the sequence LSGRSDNHGGSGG-SISSGLLSS (SEQ ID NO: 387), which is also referred to herein as substrate 0001/LP'/1001, where LP' as used in this CM1-CM2 substrate is the amino acid sequence GGSGGS (SEQ ID NO: 922). In some embodiments, the CM1-CM2 substrate includes the sequence LSGRSGNHGGSGGSISSGLLSS (SEQ ID NO: 388), which is also referred to herein as substrate 0002/LP'/1001, where LP' as used in this CM1-CM2 substrate is the amino acid sequence GGSGGS (SEQ ID NO: 922). In some embodiments, the CM1-CM2 substrate includes the sequence ISSGLLSSGGSGGSLS-GRSGNH (SEQ ID NO: 389), which is also referred to herein as substrate 1001/LP'/0002, where LP' as used in this CM1-CM2 substrate is the amino acid sequence GGSGGS (SEQ ID NO: 922). In some embodiments, the CM1-CM2 substrate includes the sequence LSGRSDNHGGSGGSQN-QALRMA (SEQ ID NO: 390), which is also referred to herein as substrate 0001/LP'/1002, where LP' as used in this CM1-CM2 substrate is the amino acid sequence GGSGGS (SEQ ID NO: 922). In some embodiments, the CM1-CM2 substrate includes the sequence QNQALRMAGGSGGSLS-GRSDNH (SEQ ID NO: 391), which is also referred to herein as substrate 1002/LP'/0001, where LP' as used in this CM1-CM2 substrate is the amino acid sequence GGSGGS (SEQ ID NO: 922). In some embodiments, the CM1-CM2 substrate includes the sequence LSGRSGNHGGSGGSQN-QALRMA (SEQ ID NO: 392), which is also referred to herein as substrate 0002/LP'/1002, where LP' as used in this CM1-CM2 substrate is the amino acid sequence GGSGGS (SEQ ID NO: 922). In some embodiments, the CM1-CM2 substrate includes the sequence QNQALRMAGGSGGSLS-GRSGNH (SEQ ID NO: 393), which is also referred to herein as substrate 1002/LP'/0002, where LP' as used in this CM1-CM2 substrate is the amino acid sequence GGSGGS (SEQ ID NO: 922). In some embodiments, the CM1-CM2 substrate includes the sequence ISSGLLSGRSGNH (SEQ ID NO: 394), which is also referred to herein as substrate 2002. In some embodiments, the CM1-CM2 substrate includes the sequence ISSGLLSGRSANPRG (SEQ ID NO: 901), which is also referred to herein as substrate 2003. In some embodiments, the CM1-CM2 substrate includes the sequence AVGLLAPPTSGRSANPRG (SEQ ID NO: 902), which is also referred to herein as substrate 2004. In some embodiments, the CM1-CM2 substrate includes the sequence AVGLLAPPSGRSANPRG (SEQ ID NO: 903), which is also referred to herein as substrate 2005. In some embodiments, the CM1-CM2 substrate includes the sequence ISSGLLSGRSDDH (SEQ ID NO: 904), which is also referred to herein as substrate 2006. In some embodiments, the CM1-CM2 substrate includes the sequence ISSGLLSGRSDIH (SEQ ID NO: 905), which is also referred to herein as substrate 2007. In some embodiments, the CM1-CM2 substrate includes the sequence ISSGLLSGRSDQH (SEQ ID NO: 906), which is also referred to herein as substrate 2008. In some embodiments, the CM1-CM2 substrate includes the sequence ISSGLLSGRSDTH (SEQ ID NO: 907), which is also referred to herein as substrate 2009. In some embodiments, the CM1-CM2 substrate includes the sequence ISSGLLSGRSDYH (SEQ ID NO: 908), which is also referred to herein as substrate 2010. In some embodiments, the CM1-CM2 substrate includes the sequence ISSGLLSGRSDNP (SEQ ID NO: 909), which is also referred to herein as substrate 2011. In some embodiments, the CM1-CM2 substrate includes the sequence ISSGLLSGRSANP (SEQ ID NO: 910), which is also referred to herein as substrate 2012. In some embodiments, the CM1-CM2 substrate includes the sequence ISSGLLSGRSANI (SEQ ID NO: 911), which is also referred to herein as substrate 2013. In some embodiments, the CM1-CM2 substrate includes the sequence AVGLLAPPGGLSGRSDDH (SEQ ID NO: 912), which is also referred to herein as substrate 3006. In some embodiments, the CM1-CM2 substrate includes the sequence AVGLLAPPGGLSGRSDIH (SEQ ID NO: 913), which is also referred to herein as substrate 3007. In some embodiments, the CM1-CM2 substrate includes the sequence AVGLLAPPGGLSGRSDQH (SEQ ID NO: 914), which is also referred to herein as substrate 3008. In some embodiments, the CM1-CM2 substrate includes the sequence AVGLLAPPGGLSGRSDTH (SEQ ID NO: 915), which is also referred to herein as substrate 3009. In some embodiments, the CM1-CM2 substrate includes the sequence AVGLLAPPGGLSGRSDDH (SEQ ID NO: 916), which is also referred to herein as substrate 3010. In some embodiments, the CM1-CM2 substrate includes the sequence AVGLLAPPGGLSGRSDNP (SEQ ID NO: 917), which is also referred to herein as substrate 3011. In some embodiments, the CM1-CM2 substrate includes the sequence AVGLLAPPGGLSGRSANP (SEQ ID NO: 918), which is also referred to herein as substrate 3012. In some embodiments, the CM1-CM2 substrate includes the sequence AVGLLAPPGGLSGRSANI (SEQ ID NO: 919), which is also referred to herein as substrate 3013. In some embodiments, the CM1-CM2 substrate includes the sequence ISSGLLSGRSDNI (SEQ ID NO: 920), which is also referred to herein as substrate 2014. In some embodiments, the CM1-CM2 substrate includes the sequence AVGLLAPPGGLSGRSDNI (SEQ ID NO: 921), which is also referred to herein as substrate 3014. In some embodiments, the CM1-CM2 substrate includes the sequence GLSGRSDNHGGAVGLLAPP (SEQ ID NO: 1009), which is also referred to herein as substrate 0001/LP'/1004, where LP' as used in this CM1-CM2 substrate is the amino acid sequence GG. In some embodiments, the CM1-CM2 substrate includes the sequence GLSGRSDNHGGVHMPLGFLGP (SEQ ID NO: 1010), which is also referred to herein as substrate 0001/LP'/1003, where LP' as used in this CM1-CM2 substrate is the amino acid sequence GG.

In some embodiments, the CM is a substrate for at least two proteases. In some embodiments, each protease is selected from the group consisting of those shown in Table 12. In some embodiments, the CM is a substrate for at least two proteases, wherein one of the proteases is selected from the group consisting of a MMP, a thrombin, a neutrophil elastase, a cysteine protease, a uPA, a legumain and a matriptase and other serine proteases and the other protease is selected from the group consisting of those shown in Table 12. In some embodiments, the CM is a substrate for at least two proteases selected from the group consisting of a MMP, a thrombin, a neutrophil elastase, a cysteine protease, a uPA, a legumain and a matriptase and other serine proteases.

In some embodiments, the activatable antibody includes at least a first CM and a second CM. In some embodiments, the first CM and the second CM are each polypeptides of no more than 15 amino acids long. In some embodiments, the first CM and the second CM in the activatable antibody in the uncleaved state have the structural arrangement from N-terminus to C-terminus as follows: MM-CM1-CM2-AB or AB-CM2-CM1-MM. In some embodiments, at least one of the first CM and the second CM is a polypeptide that functions as a substrate for a protease selected from the group consisting of a MMP, a thrombin, a neutrophil elastase, a cysteine protease, a uPA, a legumain, and a matriptase and other serine proteases. In some embodiments, the first CM is cleaved by a first cleaving agent selected from the group consisting of a MMP, a thrombin, a neutrophil elastase, a cysteine protease, a uPA, a legumain, and a matriptase and other serine proteases in a target tissue and the second CM is cleaved by a second cleaving agent in a target tissue. In some embodiments, the other protease is selected from the group consisting of those shown in Table 12. In some embodiments, the first cleaving agent and the second cleaving agent are the same protease selected from the group consisting of a MMP, a thrombin, a neutrophil elastase, a cysteine protease, a uPA, a legumain, and a matriptase and other serine proteases, and the first CM and the second CM are different substrates for the enzyme. In some embodiments, the first cleaving agent and the second cleaving agent are the same protease selected from the group consisting of those shown in Table 12. In some embodiments, the first cleaving agent and the second cleaving agent are different proteases. In some embodiments, the first cleaving agent and the second cleaving agent are co-localized in the target tissue. In some embodiments, the first CM and the second CM are cleaved by at least one cleaving agent in the target tissue.

In some embodiments, the activatable antibody is exposed to and cleaved by a protease such that, in the activated or cleaved state, the activated antibody includes a light chain amino acid sequence that includes at least a portion of LP2 and/or CM sequence after the protease has cleaved the CM.

In some embodiments, the activatable antibody also includes an agent conjugated to the AB. In some embodiments, the agent conjugated to the AB or the AB of an activatable antibody is a therapeutic agent. In some embodiments, the agent is an antineoplastic agent. In some embodiments, the agent is a toxin or fragment thereof. As used herein, a fragment of a toxin is a fragment that retains toxic activity. In some embodiments, the agent is conjugated to the AB via a cleavable linker. In some embodiments, the agent is conjugated to the AB via a linker that includes at least one CM1-CM2 substrate sequence. In some embodiments, the agent is conjugated to the AB via a noncleavable linker. In some embodiments, the agent is conjugated to the AB via a linker that is cleavable in an intracellular or lysosomal environment. In some embodiments, the agent is a microtubule inhibitor. In some embodiments, the agent is a nucleic acid damaging agent, such as a DNA alkylator, a DNA cleaving agent, a DNA cross-linker, or DNA intercalator, or other DNA damaging agent. In some embodiments, the agent is an agent selected from the group listed in Table 11. In some embodiments, the agent is a dolastatin. In some embodiments, the agent is an auristatin or derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid or maytansinoid derivative. In some embodiments, the agent is DM1 or DM4. In some embodiments, the agent is a duocarmycin or derivative thereof. In some embodiments, the agent is a calicheamicin or derivative thereof. In some embodiments, the agent is a pyrrolobenzodiazepine. In some embodiments, the agent is a pyrrolobenzodiazepine dimer.

In some embodiments, the activatable antibody is conjugated to one or more equivalents of an agent. In some embodiments, the activatable antibody is conjugated to one equivalent of the agent. In some embodiments, the activatable antibody is conjugated to two, three, four, five, six, seven, eight, nine, ten, or greater than ten equivalents of the agent. In some embodiments, the activatable antibody is part of a mixture of activatable antibodies having a homogeneous number of equivalents of conjugated agents. In some embodiments, the activatable antibody is part of a mixture of activatable antibodies having a heterogeneous number of equivalents of conjugated agents. In some embodiments, the mixture of activatable antibodies is such that the average number of agents conjugated to each activatable antibody is between zero to one, between one to two, between two and three, between three and four, between four and five, between five and six, between six and seven, between seven and eight, between eight and nine, between nine and ten, and ten and greater. In some embodiments, the mixture of activatable antibodies is such that the average number of agents conjugated to each activatable antibody is one, two, three, four, five, six, seven, eight, nine, ten, or greater.

In some embodiments, the activatable antibody comprises one or more site-specific amino acid sequence modifications such that the number of lysine and/or cysteine residues is increased or decreased with respect to the original amino acid sequence of the activatable antibody, thus in some embodiments correspondingly increasing or decreasing the number of agents that can be conjugated to the activatable antibody, or in some embodiments limiting the conjugation of the agents to the activatable antibody in a site-specific manner. In some embodiments, the modified activatable antibody is modified with one or more non-natural amino acids in a site-specific manner, thus in some embodiments limiting the conjugation of the agents to only the sites of the non-natural amino acids.

In some embodiments, the agent is an anti-inflammatory agent.

In some embodiments, the activatable antibody also includes a detectable moiety. In some embodiments, the detectable moiety is a diagnostic agent.

In some embodiments, the activatable antibody also includes a signal peptide. In some embodiments, the signal peptide is conjugated to the activatable antibody via a spacer. In some embodiments, the spacer is conjugated to the activatable antibody in the absence of a signal peptide. In some embodiments, the spacer is joined directly to the MM of the activatable antibody. In some embodiments, the spacer is joined directly to the MM of the activatable antibody in the structural arrangement from N-terminus to C-terminus of spacer-MM-CM-AB. An example of a spacer joined directly to the N-terminus of MM of the activatable antibody is selected from the group consisting of QGQSGS (SEQ ID NO: 923); GQSGS (SEQ ID NO: 1192); QSGS (SEQ ID NO: 1193); SGS (SEQ ID NO: 1194); GS (SEQ ID NO: 1195); S; QGQSGQG (SEQ ID NO: 924); GQSGQG (SEQ ID NO: 395); QSGQG (SEQ ID NO: 925); SGQG (SEQ ID NO: 926); GQG (SEQ ID NO: 927); QG (SEQ ID NO: 928); G; QGQSGQ (SEQ ID NO: 1196); GQSGQ (SEQ ID NO: 1197); QSGQ (SEQ ID NO: 1198); SGQ (SEQ ID NO: 616); GQ (SEQ ID NO: 1199); and Q. In some embodiments, the spacer includes at least the amino acid sequence QGQSGS (SEQ ID NO: 923). In some embodiments, the spacer includes at least the amino acid sequence GQSGS (SEQ ID NO: 1192). In some embodiments, the spacer includes at least the amino acid sequence QSGS (SEQ ID NO: 1193). In some embodiments, the spacer includes at least the amino acid sequence SGS (SEQ ID NO: 1194). In some embodiments, the spacer includes at least the amino acid sequence GS (SEQ ID NO: 1195). In some embodiments, the spacer includes at least the amino acid sequence S. In some embodiments, the spacer includes at least the amino acid sequence QGQSGQG (SEQ ID NO: 924). In some embodiments, the spacer includes at least the amino acid sequence GQSGQG (SEQ ID NO: 395). In some embodiments, the spacer includes at least the amino acid sequence QSGQG (SEQ ID NO: 925). In some embodiments, the spacer includes at least the amino acid sequence SGQG (SEQ ID NO: 926). In some embodiments, the spacer includes at least the amino acid sequence GQG (SEQ ID NO: 927). In some embodiments, the spacer includes at least the amino acid sequence QG (SEQ ID NO: 928). In some embodiments, the spacer includes at least the amino acid sequence G. In some embodiments, the spacer includes at least the amino acid sequence QGQSGQ (SEQ ID NO: 1196). In some embodiments, the spacer includes at least the amino acid sequence GQSGQ (SEQ ID NO: 1197). In some embodiments, the spacer includes at least the amino acid sequence QSGQ (SEQ ID NO: 1198). In some embodiments, the spacer includes at least the amino acid sequence SGQ (SEQ ID NO: 616). In some embodiments, the spacer includes at least the amino acid sequence GQ (SEQ ID NO: 1199). In some embodiments, the spacer includes at least the amino acid sequence Q. In some embodiments, the activatable antibody does not include a spacer sequence.

In some embodiments, the AB of the activatable antibody naturally contains one or more disulfide bonds. In some embodiments, the AB can be engineered to include one or more disulfide bonds.

In some embodiments, the serum half-life of the activatable antibody is longer than that of the corresponding antibody; e.g., the pK of the activatable antibody is longer than that of the corresponding antibody. In some embodiments, the serum half-life of the activatable antibody is similar to that of the corresponding antibody. In some embodiments, the serum half-life of the activatable antibody is at least 15 days when administered to an organism. In some embodiments, the serum half-life of the activatable antibody is at least 12 days when administered to an organism. In some embodiments, the serum half-life of the activatable antibody is at least 11 days when administered to an organism. In some embodiments, the serum half-life of the activatable antibody is at least 10 days when administered to an organism. In some embodiments, the serum half-life of the activatable antibody is at least 9 days when administered to an organism. In some embodiments, the serum half-life of the activatable antibody is at least 8 days when administered to an organism. In some embodiments, the serum half-life of the activatable antibody is at least 7 days when administered to an organism. In some embodiments, the serum half-life of the activatable antibody is at least 6 days when administered to an organism. In some embodiments, the serum half-life of the activatable antibody is at least 5 days when administered to an organism. In some embodiments, the serum half-life of the activatable antibody is at least 4 days when administered to an organism. In some embodiments, the serum half-life of the activatable antibody is at least 3 days when administered to an organism. In some embodiments, the serum half-life of the activatable antibody is at least 2 days when administered to an organism. In some embodiments, the serum half-life of the activatable antibody is at least 24 hours when administered to an organism. In some embodiments, the serum half-life of the activatable antibody is at least 20 hours when administered to an organism. In some embodiments, the serum half-life of the activatable antibody is at least 18 hours when administered to an organism. In some embodiments, the serum half-life of the activatable antibody is at least 16 hours when administered to an organism. In some embodiments, the serum half-life of the activatable antibody is at least 14 hours when administered to an organism. In some embodiments, the serum half-life of the activatable antibody is at least 12 hours when administered to an organism. In some embodiments, the serum half-life of the activatable antibody is at least 10 hours when administered to an organism. In some embodiments, the serum half-life of the activatable antibody is at least 8 hours when administered to an organism. In some embodiments, the serum half-life of the activatable antibody is at least 6 hours when administered to an organism. In some embodiments, the serum half-life of the activatable antibody is at least 4 hours when administered to an organism. In some embodiments, the serum half-life of the activatable antibody is at least 3 hours when administered to an organism.

In some embodiments, the activatable anti-PDL1 antibody and/or conjugated activatable anti-PDL1 antibody is monospecific. In some embodiments, the activatable anti-PDL1 antibody and/or conjugated activatable anti-PDL1 antibody is multispecific, e.g., by way of non-limiting example, bispecific or trifunctional. In some embodiments, the activatable anti-PDL1 antibody and/or conjugated activatable anti-PDL1 antibody is formulated as part of a pro-Bispecific T Cell Engager (BITE) molecule, i.e., the BITE includes a masking moiety and a cleavable moiety. In some embodiments, the activatable anti-PDL1 antibody and/or conjugated activatable anti-PDL1 antibody is formulated as part of a pro-Chimeric Antigen Receptor (CAR)-modified T cell, -modified NK cell, or other-modified immune effector cell. In some embodiments, an activatable anti-PDL1 antibody is formulated as part of another engineered receptor on an immune effector cell; i.e., the pro-CAR or other pro-engineered receptor includes a masking moiety and a cleavable moiety.

In some embodiments, the activatable antibody or antigen-binding fragment thereof is incorporated in a multispecific activatable antibody or antigen-binding fragment thereof, where at least one arm of the multispecific activatable antibody specifically binds PDL1. In some embodiments, the activatable antibody or antigen-binding fragment thereof is incorporated in a bispecific antibody or antigen-binding fragment thereof, where at least one arm of the bispecific activatable antibody specifically binds PDL1.

In some embodiments, at least one arm of the multispecific activatable antibody, e.g., a bispecific activatable antibody, comprises a heavy chain amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, at least one arm of the multispecific activatable antibody, e.g., a bispecific activatable antibody, comprises a light chain amino acid sequence comprising SEQ ID NO: 12 or SEQ ID NO: 58. In some embodiments, at least one arm of the multispecific activatable antibody, e.g., a bispecific activatable antibody, comprises a light chain amino acid sequence comprising SEQ ID NO: 12. In some embodiments, at least one arm of the multispecific activatable antibody, e.g., a bispecific activatable antibody, comprises a light chain amino acid sequence comprising SEQ ID NO: 58.

In some embodiments, at least one arm of the multispecific activatable antibody, e.g., a bispecific activatable antibody, a heavy chain amino acid sequence comprising an amino acid sequence selected from the group consisting of SEQ ID NO: 46, 48, 50, 52, 54, and 56, and a light chain amino acid sequence comprising SEQ ID NO: 58.

In some embodiments, at least one arm of the multispecific activatable antibody, e.g., a bispecific activatable antibody, comprises a heavy chain amino acid sequence comprising an amino acid sequence selected from the group consisting of SEQ ID NO: 46, 48, 50, 52, 54, and 56, and a light chain amino acid sequence comprising SEQ ID NO: 12.

In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56. In some embodiments, at least one arm of the multispecific activatable antibody, e.g., a bispecific activatable antibody, comprises a light chain amino acid that is at least 90%, 91%, 92%, 93%, 94%, 95%, 96%, 97%, 98% or 99% identical to the amino acid sequence of SEQ ID NO: 58. In some embodiments, at least one arm of the multispecific activatable antibody, e.g., a bispecific activatable antibody, comprises a light chain amino acid that is at least 90%, 91%, 92%, 93%, 94%, 95%, 96%, 97%, 98% or 99% identical to the amino acid sequence of SEQ ID NO: 12. In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a light chain amino acid that is at least 90%, 91%, 92%, 93%, 94%, 95%, 96%, 97%, 98% or 99% identical to the amino acid sequence of SEQ ID NO: 58. In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 46, 48, 50, 52, 54, and 56, and a light chain amino acid that is at least 90%, 91%, 92%, 93%, 94%, 95%, 96%, 97%, 98% or 99% identical to the amino acid sequence of SEQ ID NO: 12.

In some embodiments, at least one arm of the multispecific activatable antibody, e.g., a bispecific activatable antibody, comprises the heavy chain amino acid sequence of SEQ ID NO: 46 and the light chain amino acid sequence of SEQ ID NO: 58. In some embodiments, at least one arm of the multispecific activatable antibody, e.g., a bispecific activatable antibody, comprises the heavy chain amino acid sequence of SEQ ID NO: 46 and the light chain amino acid sequence of SEQ ID NO: 12.

In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to the amino acid of SEQ ID NO: 46. In some embodiments, at least one arm of the multispecific activatable antibody, e.g., a bispecific activatable antibody, comprises a light chain amino acid that is at least 90%, 91%, 92%, 93%, 94%, 95%, 96%, 97%, 98% or 99% identical to the amino acid sequence of SEQ ID NO: 58. In some embodiments, at least one arm of the multispecific activatable antibody, e.g., a bispecific activatable antibody, comprises a light chain amino acid that is at least 90%, 91%, 92%, 93%, 94%, 95%, 96%, 97%, 98% or 99% identical to the amino acid sequence of SEQ ID NO: 12. In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to the amino acid sequence selected of SEQ ID NO: 46, and a light chain amino acid that is at least 90%, 91%, 92%, 93%, 94%, 95%, 96%, 97%, 98% or 99% identical to the amino acid sequence of SEQ ID NO: 58. In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to the amino acid sequence selected of SEQ ID NO: 46, and a light chain amino acid that is at least 90%, 91%, 92%, 93%, 94%, 95%, 96%, 97%, 98% or 99% identical to the amino acid sequence of SEQ ID NO: 12.

In some embodiments, at least one arm of the multispecific activatable antibody, e.g., a bispecific activatable antibody, comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 16; a VH CDR2 sequence shown in Table 16; a VH CDR3 sequence shown in Table 16; a VL CDR1 sequence shown in Table 16; a VL CDR2 sequence shown in Table 16; and a VL CDR3 sequence shown in Table 16.

In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 16; a VH CD2 sequence that includes a sequence that is at least 90%, 91%, 92%, 93%, 94%, 95%, 96%, 97%, 98%, 99% or more identical to a VH CDR2 sequence shown in Table 16; a VH CDR3 sequence that includes a sequence that is at least 90%, 91%, 92%, 93%, 94%, 95%, 96%, 97%, 98%, 99% or more identical to a VH CDR3 sequence shown in Table 16; a VL CDR1 sequence that includes a sequence that is at least 90%, 91%, 92%, 93%, 94%, 95%, 96%, 97%, 98%, 99% or more identical to a VL CDR1 sequence shown in Table 16; a VL CDR2 sequence that includes a sequence that is at least 90%, 91%, 92%, 93%, 94%, 95%, 96%, 97%, 98%, 99% or more identical to a VL CDR2 sequence shown in Table 16; and a VL CDR3 sequence that includes a sequence that is at least 90%, 91%, 92%, 93%, 94%, 95%, 96%, 97%, 98%, 99% or more identical to a VL CDR3 sequence shown in Table 16.

In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 16.

In some embodiments, the antibody comprises a heavy chain that comprise a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 16.

In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of the six CDR sequences (VH CDR1, VH CDR2, VH CDR3, VL CDR1, VL CDR2, and VL CDR3) shown in a single row in Table 16.

In some embodiments, the antibody comprises a heavy chain that comprise a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 16.

In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein the VH CDR2 sequence comprises SSIWRNGIVTVYADS (SEQ ID NO: 246). In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein the VH CDR3 sequence comprises WSAAFDY (SEQ ID NO: 235). In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein the VH CDR2 sequence comprises SSIWRNGIVTVYADS (SEQ ID NO: 246), and the VH CDR3 sequence comprises WSAAFDY (SEQ ID NO: 235).

In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein the combination comprises a VL CDR1 sequence comprising RASQSISSYLN (SEQ ID NO: 209); a VL CDR2 sequence comprising AASSLQS (SEQ ID NO: 215); a VL CDR3 sequence comprising DNGYPST (SEQ ID NO: 228); a VH CDR1 sequence comprising SYAMS (SEQ ID NO: 212); a VH CDR2 sequence comprising SSIWRNGIVTVYADS (SEQ ID NO: 246); and a VH CDR3 sequence comprising WSAAFDY (SEQ ID NO: 235).

In some embodiments, the anti-PDL1 antibodies, conjugated anti-PDL1 antibodies, activatable anti-PDL1 antibodies and/or conjugated activatable anti-PDL1 antibodies described herein are used as sole active agents. In some embodiments, the anti-PDL1 antibodies, conjugated anti-PDL1 antibodies, activatable anti-PDL1 antibodies and/or conjugated activatable anti-PDL1 antibodies described herein are used in conjunction with one or more additional agents or a combination of additional agents. Suitable additional agents include current pharmaceutical and/or surgical therapies for an intended application, such as, for example, cancer. For example, the anti-PDL1 antibodies, conjugated anti-PDL1 antibodies, activatable anti-PDL1 antibodies and/or conjugated activatable anti-PDL1 antibodies can be used in conjunction with an additional chemotherapeutic or antineoplastic agent.

In some embodiments, the additional agent(s) is a chemotherapeutic agent, such as a chemotherapeutic agent selected from the group consisting of docetaxel, paclitaxel, abraxane (i.e., albumin-conjugated paclitaxel), doxorubicin, oxaliplatin, carboplatin, cisplatin, irinotecan, and gemcitabine.

In some embodiments, the additional agent(s) is a checkpoint inhibitor, a kinase inhibitor, an agent targeting inhibitors in the tumor microenvironment, and/or a T cell or NK agonist. In some embodiments, the additional agent(s) is radiation therapy, alone or in combination with another additional agent(s) such as a chemotherapeutic or antineoplastic agent. In some embodiments, the additional agent (s) is a vaccine, an oncovirus, and/or a DC-activating agent such as, by way of non-limiting example, a toll-like receptor (TLR) agonist and/or α-CD40. In some embodiments, the additional agent(s) is a tumor-targeted antibody designed to kill the tumor via ADCC or via direct conjugation to a toxin (e.g., an antibody drug conjugate (ADC).

In some embodiments, the checkpoint inhibitor is an inhibitor of a target selected from the group consisting of CTLA-4, LAG-3, PD1 (also referred to as PD-1), PDL1, TIGIT, TIM-3, B7H4, and Vista. In some embodiments, the kinase inhibitor is selected from the group consisting of B-RAFi, MEKi, and Btk inhibitors, such as ibrutinib. In some embodiments, the kinase inhibitor is crizotinib. In some embodiments, the tumor microenvironment inhibitor is selected from the group consisting of an IDO inhibitor, an α-CSF1R inhibitor, an α-CCR4 inhibitor, a TGF-beta, a myeloid-derived suppressor cell, or a T-regulatory cell. In some embodiments, the agonist is selected from the group consisting of Ox40, GITR, CD137, ICOS, CD27, and HVEM.

In some embodiments, the inhibitor is a CTLA-4 inhibitor. In some embodiments, the inhibitor is a LAG-3 inhibitor. In some embodiments, the inhibitor is a PD1 inhibitor. In some embodiments, the inhibitor is a PDL1 inhibitor. In some embodiments, the inhibitor is a TIGIT inhibitor. In some embodiments, the inhibitor is a TIM-3 inhibitor. In some embodiments, the inhibitor is a B7H4 inhibitor. In some embodiments, the inhibitor is a Vista inhibitor. In some embodiments, the inhibitor is a B-RAFi inhibitor. In some embodiments, the B-RAFi inhibitor is vemurafenib. In some embodiments, the inhibitor is a MEKi inhibitor. In some embodiments, the inhibitor is a Btk inhibitor. In some embodiments, the inhibitor is ibrutinib. In some embodiments, the inhibitor is crizotinib. In some embodiments, the inhibitor is an IDO inhibitor. In some embodiments, the inhibitor is an α-CSF1R inhibitor. In some embodiments, the inhibitor is an α-CCR4 inhibitor. In some embodiments, the inhibitor is a TGF-beta. In some embodiments, the inhibitor is a myeloid-derived suppressor cell. In some embodiments, the inhibitor is a T-regulatory cell.

In some embodiments, the agonist is Ox40. In some embodiments, the agonist is GITR. In some embodiments, the agonist is CD137. In some embodiments, the agonist is ICOS. In some embodiments, the agonist is CD27. In some embodiments, the agonist is HVEM.

In some embodiments, the anti-PDL1 antibody, conjugated antibody, activatable antibody and/or conjugated activatable antibody is administered before and/or during and/or after treatment in combination with one or more additional agents such as, for example, a chemotherapeutic agent, an anti-inflammatory agent, and/or an immunosuppressive agent. In some embodiments, the anti-PDL1 antibody, conjugated anti-PDL1 antibody, activatable anti-PDL1 antibody and/or conjugated activatable anti-PDL1 antibody and the additional agent are formulated into a single therapeutic composition, and the anti-PDL1 antibody, conjugated anti-PDL1 antibody, activatable anti-PDL1 antibody and/or conjugated activatable anti-PDL1 antibody and additional agent are administered simultaneously. Alternatively, the anti-PDL1 antibody, conjugated anti-PDL1 antibody, activatable anti-PDL1 antibody and/or conjugated activatable anti-PDL1 antibody and additional agent are separate from each other, e.g., each is formulated into a separate therapeutic composition, and the anti-PDL1 antibody, conjugated anti-PDL1 antibody, activatable anti-PDL1 antibody and/or conjugated activatable anti-PDL1 antibody and the additional agent are administered simultaneously, or the anti-PDL1 antibody, conjugated anti-PDL1 antibody, activatable anti-PDL1 antibody and/or conjugated activatable anti-PDL1 antibody and the additional agent are administered at different times during a treatment regimen. For example, the anti-PDL1 antibody, conjugated anti-PDL1 antibody, activatable anti-PDL1 antibody and/or conjugated activatable anti-PDL1 antibody is administered prior to the administration of the additional agent, the anti-PDL1 antibody, conjugated anti-PDL1 antibody, activatable anti-PDL1 antibody and/or conjugated activatable anti-PDL1 antibody is administered subsequent to the administration of the additional agent, or the anti-PDL1 antibody, conjugated anti-PDL1 antibody, activatable anti-PDL1 antibody and/or conjugated activatable anti-PDL1 antibody and the additional agent are administered in an alternating fashion. As described herein, the anti-PDL1 antibody, conjugated anti-PDL1 antibody, activatable anti-PDL1 antibody and/or conjugated activatable anti-PDL1 antibody and additional agent are administered in single doses or in multiple doses.

In some embodiments, the anti-PDL1 antibody, conjugated anti-PDL1 antibody, activatable anti-PDL1 antibody and/or conjugated activatable anti-PDL1 antibody and the additional agent(s) are administered simultaneously. For example, the anti-PDL1 antibody, conjugated anti-PDL1 antibody, activatable anti-PDL1 antibody and/or conjugated activatable anti-PDL1 antibody and the additional agent(s) can be formulated in a single composition or administered as two or more separate compositions. In some embodiments, the anti-PDL1 antibody, conjugated anti-PDL1 antibody, activatable anti-PDL1 antibody and/or conjugated activatable anti-PDL1 antibody and the additional agent(s) are administered sequentially, or the anti-PDL1 antibody, conjugated anti-PDL1 antibody, activatable anti-PDL1 antibody and/or conjugated activatable anti-PDL1 antibody and the additional agent are administered at different times during a treatment regimen.

In some embodiments, the anti-PDL1 antibody, conjugated anti-PDL1 antibody, activatable anti-PDL1 antibody and/or conjugated activatable anti-PDL1 antibody is administered before and/or during and/or after treatment in combination with one or more additional agents such as, by way of non-limiting example, a chemotherapeutic agent, an anti-inflammatory agent, and/or an immunosuppressive agent, such as an alkylating agent, an anti-metabolite, an anti-microtubule agent, a topoisomerase inhibitor, a cytotoxic antibiotic, and/or any other nucleic acid damaging agent. In some embodiments, the additional agent is a taxane, such as paclitaxel (e.g., Abraxane®). In some embodiments, the additional agent is an anti-metabolite, such as gemcitabine. In some embodiments, the additional agent is an alkylating agent, such as platinum-based chemotherapy, such as carboplatin or cisplatin. In some embodiments, the additional agent is a targeted agent, such as a kinase inhibitor, e.g., sorafenib or erlotinib. In some embodiments, the additional agent is a targeted agent, such as another antibody, e.g., a monoclonal antibody (e.g., bevacizumab), a bispecific antibody, or a multispecific antibody. In some embodiments, the additional agent is a proteosome inhibitor, such as bortezomib or carfilzomib. In some embodiments, the additional agent is an immune modulating agent, such as lenolidominde or IL-2. In some embodiments, the additional agent is radiation. In some embodiments, the additional agent is an agent considered standard of care by those skilled in the art. In some embodiments, the additional agent is a chemotherapeutic agent well known to those skilled in the art.

In some embodiments, the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof. In some embodiments the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof against the same target as the first antibody or antigen-binding fragment thereof, the first conjugated antibody or antigen-binding fragment thereof, activatable antibody or antigen-binding fragment thereof and/or a conjugated activatable antibody or antigen-binding fragment thereof, e.g., against PDL1. In some embodiments the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof against a target different than the target of the first antibody or antigen-binding fragment thereof, the first conjugated antibody or antigen-binding fragment thereof, activatable antibody or antigen-binding fragment thereof and/or a conjugated activatable antibody or antigen-binding fragment thereof (i.e., target other than PDL1). In some embodiments, the additional agent is a chimeric antigen receptor-modified T cell, -modified NK cell or other-modified immune effector cell or is another engineered receptor-modified immune effector cell. In some embodiments, the additional agent is a pro-chimeric antigen receptor-modified T cell, -modified NK cell, or other-modified immune effector cell or is another pro-engineered receptor-modified immune effector cell.

As a non-limiting example, the antibody or antigen-binding fragment and/or the AB of an activatable antibody is a binding partner for any target listed in Table 22. In some embodiments that additional agent is ipilimumab, a CTLA4-binding fragment of ipilimumab, and/or an ipilimumab activatable antibody.

TABLE 22

| Exemplary Targets | | | | | |
|---|---|---|---|---|---|
| 1-92-LFA-3 | CD52 | DL44 | HVEM | LIF-R | STEAP1 |
| Alpha-4 integrin | CD56 | DLK1 | Hyaluronidase | Lewis X | STEAP2 |
| Alpha-V integrin | CD64 | DLL4 | ICOS | LIGHT | TAG-72 |
| alpha4beta1 integrin | CD70 | DPP-4 | IFNalpha | LRP4 | TAPA1 |

TABLE 22-continued

Exemplary Targets

| | | | | | |
|---|---|---|---|---|---|
| alpha4beta7 integrin | CD71 | DSG1 | IFNbeta | LRRC26 | TGFbeta |
| AGR2 | CD74 | EGFR | IFNgamma | MCSP | TIGIT |
| Anti-Lewis-Y | | EGFRviii | IgE | Mesothelin | TIM-3 |
| Apelin J receptor | CD80 | Endothelin B receptor (ETBR) | IgE Receptor (FceRI) | MRP4 | TLR2 |
| APRIL | CD81 | ENPP3 | IGF | MUC1 | TLR4 |
| B7-H4 | CD86 | EpCAM | IGF1R | Mucin-16 (MUC16, CA-125) | TLR6 |
| BAFF | CD95 | EPHA2 | IL1B | Na/K ATPase | TLR7 |
| BTLA | CD117 | EPHB2 | IL1R | Neutrophil elastase | TLR8 |
| C5 complement | CD125 | ERBB3 | IL2 | NGF | TLR9 |
| C-242 | CD132 (IL-2RG) | F protein of RSV | IL11 | Nicastrin | TMEM31 |
| CA9 | CD133 | FAP | IL12 | Notch Receptors | TNFalpha |
| CA19-9 (Lewis a) | CD137 | FGF-2 | IL12p40 | Notch 1 | TNFR |
| Carbonic anhydrase 9 | CD138 | FGF8 | IL-12R, IL-12Rbeta1 | Notch 2 | TNFRS12A |
| CD2 | CD166 | FGFR1 | IL13 | Notch 3 | TRAIL-R1 |
| CD3 | CD172A | FGFR2 | IL13R | Notch 4 | TRAIL-R2 |
| CD6 | CD248 | FGFR3 | IL15 | NOV | Transferrin |
| CD9 | CDH6 | FGFR4 | IL17 | OSM-R | Transferrin receptor |
| CD11a | CEACAM5 (CEA) | Folate receptor | IL18 | OX-40 | TRK-A |
| CD19 | CEACAM6 (NCA-90) | GAL3ST1 | IL21 | PAR2 | TRK-B |
| CD20 | CLAUDIN-3 | G-CSF | IL23 | PDGF-AA | uPAR |
| CD22 | CLAUDIN-4 | G-CSFR | IL23R | PDGF-BB | VAP1 |
| CD24 | cMet | GD2 | IL27/IL27R (wsx1) | PDGFRalpha | VCAM-1 |
| CD25 | Collagen | GITR | IL29 | PDGFRbeta | VEGF |
| CD27 | Cripto | GLUT1 | IL-31R | PD-1 | VEGF-A |
| CD28 | CSFR | GLUT4 | IL31/IL31R | PD-L1 | VEGF-B |
| CD30 | CSFR-1 | GM-CSF | IL2R | PD-L2 | VEGF-C |
| CD33 | CTLA-4 | GM-CSFR | IL4 | Phosphatidyl-serine | VEGF-D |
| CD38 | CTGF | GP IIb/IIIa receptors | IL4R | P1GF | VEGFR1 |
| CD40 | CXCL10 | Gp130 | IL6, IL6R | PSCA | VEGFR2 |
| CD40L | CXCL13 | GPIIB/IIIA | Insulin Receptor | PSMA | VEGFR3 |
| CD41 | CXCR1 | GPNMB | Jagged Ligands | RAAG12 | VISTA |
| CD44 | CXCR2 | GRP78 | Jagged 1 | RAGE | WISP-1 |
| CD44v6 | | HER2/neu | Jagged 2 | SLC44A4 | WISP-2 |
| CD47 | CXCR4 | HGF | LAG-3 | Sphingosine 1 Phosphate | WISP-3 |
| CD51 | CYR61 | hGH | | | |

As a non-limiting example, the antibody or antigen-binding fragment and/or the AB of an activatable antibody is or is derived from an antibody listed in Table 23.

TABLE 23

Exemplary sources for Abs

| Antibody Trade Name (antibody name) | Target |
|---|---|
| Avastin ™ (bevacizumab) | VEGF |
| Lucentis ™ (ranibizumab) | VEGF |
| Erbitux ™ (cetuximab) | EGFR |
| Vectibix ™ (panitumumab) | EGFR |
| Remicade ™ (infliximab) | TNFα |
| Humira ™ (adalimumab) | TNFα |
| Tysabri ™ (natalizumab) | Integrinα4 |
| Simulect ™ (basiliximab) | IL2R |
| Soliris ™ (eculizumab) | Complement C5 |

TABLE 23-continued

Exemplary sources for Abs

| Antibody Trade Name (antibody name) | Target |
|---|---|
| Raptiva ™ (efalizumab) | CD11a |
| Bexxar ™ (tositumomab) | CD20 |
| Zevalin ™ (ibritumomab tiuxetan) | CD20 |
| Rituxan ™ (ritoximab) | CD20 |
| (Ocrelizumab) | CD20 |
| Arzerra ™ (ofatumumab) | CD20 |
| Gazyva ™ (Obinutuzumab) | CD20 |
| Zenapax ™ (daclizumab) | CD25 |
| Adcetris ™ (brentuximab vedotin) | CD30 |
| Myelotarg ™ (gemtuzumab) | CD33 |
| Mylotarg ™ (gemtuzumab ozogamicin) | CD33 |
| Campath ™ (alemtuzumab) | CD52 |
| ReoPro ™ (abicizimab) | Glycoprotein receptor IIb/IIIa |

TABLE 23-continued

Exemplary sources for Abs

| Antibody Trade Name (antibody name) | Target |
| --- | --- |
| Xolair ™ (omalizumab) | IgE |
| Herceptin ™ (trastuzumab) | Her2 |
| Kadcyla ™ (trastuzumab emtansine) | Her2 |
| Synagis ™ (palivizumab) | F protein of RSV |
| (ipilimumab) | CTLA-4 |
| (tremelimumab) | CTLA-4 |
| Hu5c8 | CD40L |
| (pertuzumab) | Her2-neu |
| (ertumaxomab) | CD3/Her2-neu |
| Orencia ™ (abatacept) | CTLA-4 |
| (tanezumab) | NGF |
| (bavituximab) | Phosphatidylserine |
| (zalutumumab) | EGFR |
| (mapatumumab) | EGFR |
| (matuumab) | EGFR |
| (nimotuzumab) | EGFR |
| ICR62 | EGFR |
| mAb 528 | EGFR |
| CH806 | EGFR |
| MDX-447 | EGFR/CD64 |
| (edrecolamab) | EpCAM |
| RAV12 | RAAG12 |
| huJ591 | PSMA |
| Enbrel ™ (etanercept) | TNF-R |
| Amevive ™ (alefacept) | 1-92-LFA-3 |
| Antril ™, Kineret ™ (ankinra) | IL-1Ra |
| GC1008 | TGFbeta |
|  | Notch, e.g., Notch 1 Jagged 1 or Jagged 2 |
| (adecatumumab) | EpCAM |
| (figitumumab) | IGF1R |
| (tocilizumab) | IL-6 receptor |
| Stelara ™ (ustekinumab) | IL-12/IL-23 |
| Prolia ™ (denosumab) | RANKL |

In some embodiments, the additional antibody or antigen binding fragment thereof, conjugated antibody or antigen binding fragment thereof, activatable antibody or antigen binding fragment thereof, and/or conjugated activatable antibody or antigen binding fragment thereof is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, the additional antibody or antigen binding fragment thereof, conjugated antibody or antigen binding fragment thereof, activatable antibody or antigen binding fragment thereof, and/or conjugated activatable antibody or antigen binding fragment thereof is a mouse, other rodent, chimeric, humanized or fully human monoclonal antibody.

The disclosure also provides methods of producing an anti-PDL1 antibody and/or activatable anti-PDL1 antibody polypeptide by culturing a cell under conditions that lead to expression of the polypeptide, wherein the cell comprises an isolated nucleic acid molecule encoding an antibody and/or an activatable antibody described herein, and/or vectors that include these isolated nucleic acid sequences. The disclosure provides methods of producing an antibody and/or activatable antibody by culturing a cell under conditions that lead to expression of the antibody and/or activatable antibody, wherein the cell comprises an isolated nucleic acid molecule encoding an antibody and/or an activatable antibody described herein, and/or vectors that include these isolated nucleic acid sequences.

The invention also provides a method of manufacturing activatable antibodies that in an activated state binds PDL1 by (a) culturing a cell comprising a nucleic acid construct that encodes the activatable antibody under conditions that lead to expression of the activatable antibody, wherein the activatable antibody comprises a masking moiety (MM), a cleavable moiety (CM), and an antibody or an antigen binding fragment thereof (AB) that specifically binds PDL1, (i) wherein the CM is a polypeptide that functions as a substrate for a protease; and (ii) wherein the CM is positioned in the activatable antibody such that, when the activatable antibody is in an uncleaved state, the MM interferes with specific binding of the AB to PDL1 and in a cleaved state the MM does not interfere or compete with specific binding of the AB to PDL1; and (b) recovering the activatable antibody. Suitable AB, MM, and/or CM include any of the AB, MM, and/or CM disclosed herein.

In some embodiments, the activatable antibody in the uncleaved state has the structural arrangement from N-terminus to C-terminus as follows: MM-CM-AB or AB-CM-MM. In some embodiments, the activatable antibody comprises a linking peptide between the MM and the CM. In some embodiments, the activatable antibody comprises a linking peptide between the CM and the AB. In some embodiments, the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM. In some embodiments, the activatable antibody in the uncleaved state has the structural arrangement from N-terminus to C-terminus as follows: spacer-MM-LP1-CM-LP2-AB or AB-LP2-CM-LP1-MM-spacer. In some embodiments, the two linking peptides need not be identical to each other.

In some embodiments, at least one of LP1 or LP2 comprises an amino acid sequence selected from the group consisting of (GS)$_n$, (GGS)$_n$, (GSGGS)$_n$ (SEQ ID NO: 191) and (GGGS)$_n$ (SEQ ID NO: 192), where n is an integer of at least one.

In some embodiments, at least one of LP1 or LP2 comprises an amino acid sequence selected from the group consisting of GGSG (SEQ ID NO: 193), GGSGG (SEQ ID NO: 194), GSGSG (SEQ ID NO: 195), GSGGG (SEQ ID NO: 196), GGGSG (SEQ ID NO: 197), and GSSSG (SEQ ID NO: 198).

In some embodiments, LP1 comprises the amino acid sequence GSSGGSGGSGGSG (SEQ ID NO: 199), GSSGGSGGSGG (SEQ ID NO: 200), GSSGGSGGSGGS (SEQ ID NO: 201), GSSGGSGGSGGSGGS (SEQ ID NO: 202), GSSGGSGGSG (SEQ ID NO: 203), or GSSGGSGGSGS (SEQ ID NO: 204).

In some embodiments, LP2 comprises the amino acid sequence GSS, GGS, GGGS (SEQ ID NO: 205), GSSGT (SEQ ID NO: 206) or GSSG (SEQ ID NO: 207).

The invention provides methods of preventing, delaying the progression of, treating, alleviating a symptom of, or otherwise ameliorating an PDL1 mediated disease in a subject by administering a therapeutically effective amount of an anti-PDL1 antibody, conjugated anti-PDL1 antibody, activatable anti-PDL1 antibody and/or conjugated activatable anti-PDL1 antibody described herein to a subject in need thereof.

The invention also provides methods of preventing, delaying the progression of, treating, alleviating a symptom of, or otherwise ameliorating cancer in a subject by administering a therapeutically effective amount of an anti-PDL1 antibody, conjugated anti-PDL1 antibody, activatable anti-PDL1 antibody and/or conjugated activatable anti-PDL1 antibody described herein to a subject in need thereof. PDL1 is known to be expressed in a variety of cancers, such as, by way of non-limiting example, melanoma, non-small cell lung cancer, nasopharyngeal cancer, glioblastoma/mixed glioma, colon adenocarcinoma, hepatocellular carcinoma, urothelial cancer, multiple myeloma, ovarian cancer, gastric carcinoma, esophageal cancer, pancreatic cancer, renal cell carcinoma (RCC), breast cancer, lymphomas, and leukemias. (See e.g., Chen et al., "Molecular Pathways: Next-Generation Immunotherapy—Inhibiting Programmed Death-Ligand 1 and Programmed Death-1," Clin. Can. Res., vol. 18: 6580-6587 (2012), the contents of which are hereby incorporated by reference in their entirety).

In some embodiments, the cancer is a bladder cancer, a bone cancer, a breast cancer, a carcinoid, a cervical cancer, a colon cancer, an endometrial cancer, a glioma, a head and neck cancer, a liver cancer, a lung cancer, a lymphoma, a melanoma, an ovarian cancer, a pancreatic cancer, a prostate cancer, a renal cancer, a sarcoma, a skin cancer, a stomach cancer, a testis cancer, a thyroid cancer, a urogenital cancer, and/or a urothelial cancer.

In some embodiments, the cancer is selected from the group consisting of melanoma (MEL), renal cell carcinoma (RCC), squamous non-small cell lung cancer (NSCLC), non-squamous NSCLC, colorectal cancer (CRC), castration-resistant prostate cancer (CRPC), hepatocellular carcinoma (HCC), squamous cell carcinoma of the head and neck, carcinomas of the esophagus, ovary, gastrointestinal tract and breast, or a hematologic malignancy such as multiple myeloma, B-cell lymphoma, T-cell lymphoma, Hodgkin's lymphoma/primary mediastinal B-cell lymphoma, and chronic myelogenous leukemia. In some embodiments, the cancer is due to a PDL1-expressing tumor.

The invention also provides methods of treating cancer patients with an autoimmune or inflammatory disease by administering a therapeutically effective amount of an anti-PDL1 antibody, conjugated anti-PDL1 antibody, activatable anti-PDL1 antibody and/or conjugated activatable anti-PDL1 antibody described herein to a subject in need thereof. In some embodiments, the autoimmune disease is colitis, RA, pancreatitis, diabetes, or pneumonitis.

An anti-PDL1 antibody, a conjugated anti-PDL1 antibody, an activatable anti-PDL1 antibody and/or a conjugated activatable anti-PDL1 antibody used in any of the embodiments of these methods and uses can be administered at any stage of the disease. For example, such an anti-PDL1 antibody, conjugated anti-PDL1 antibody, activatable anti-PDL1 antibody and/or conjugated activatable anti-PDL1 antibody can be administered to a patient suffering cancer of any stage, from early to metastatic. The terms subject and patient are used interchangeably herein.

In some embodiments, the subject is a mammal, such as a human, non-human primate, companion animal (e.g., cat, dog, horse), farm animal, work animal, or zoo animal. In some embodiments, the subject is a human. In some embodiments, the subject is a companion animal. In some embodiments, the subject is an animal in the care of a veterinarian.

The anti-PDL1 antibody, conjugated anti-PDL1 antibody, activatable anti-PDL1 antibody and/or conjugated activatable anti-PDL1 antibody and therapeutic formulations thereof are administered to a subject suffering from or susceptible to a disease or disorder associated with aberrant PDL1 expression and/or activity. A subject suffering from or susceptible to a disease or disorder associated with aberrant PDL1 expression and/or activity is identified using any of a variety of methods known in the art. For example, subjects suffering from cancer or other neoplastic condition are identified using any of a variety of clinical and/or laboratory tests such as, physical examination and blood, urine and/or stool analysis to evaluate health status. For example, subjects suffering from inflammation and/or an inflammatory disorder are identified using any of a variety of clinical and/or laboratory tests such as physical examination and/or bodily fluid analysis, e.g., blood, urine and/or stool analysis, to evaluate health status.

Administration of an anti-PDL1 antibody, conjugated anti-PDL1 antibody, activatable anti-PDL1 antibody and/or conjugated activatable anti-PDL1 antibody to a patient suffering from a disease or disorder associated with aberrant PDL1 expression and/or activity is considered successful if any of a variety of laboratory or clinical objectives is achieved. For example, administration of an anti-PDL1 antibody, conjugated anti-PDL1 antibody, activatable anti-PDL1 antibody and/or conjugated activatable anti-PDL1 antibody to a patient suffering from a disease or disorder associated with aberrant PDL1 expression and/or activity is considered successful if one or more of the symptoms associated with the disease or disorder is alleviated, reduced, inhibited or does not progress to a further, i.e., worse, state. Administration of an anti-PDL1 antibody, conjugated anti-PDL1 antibody, activatable anti-PDL1 antibody and/or conjugated activatable anti-PDL1 antibody to a patient suffering from a disease or disorder associated with aberrant PDL1 expression and/or activity is considered successful if the disease or disorder enters remission or does not progress to a further, i.e., worse, state.

In some embodiments, the anti-PDL1 antibody, conjugated anti-PDL1 antibody, activatable anti-PDL1 antibody and/or conjugated activatable anti-PDL1 antibody is administered before and/or during and/or after treatment in combination with one or more additional agents such as, for example, a chemotherapeutic agent, an anti-inflammatory agent, and/or an immunosuppressive agent. In some embodiments, the anti-PDL1 antibody, conjugated anti-PDL1 antibody, activatable anti-PDL1 antibody and/or conjugated activatable anti-PDL1 antibody and the additional agent(s) are administered simultaneously. For example, the anti-PDL1 antibody, conjugated anti-PDL1 antibody, activatable anti-PDL1 antibody and/or conjugated activatable anti-PDL1 antibody and the additional agent(s) can be formulated in a single composition or administered as two or more separate compositions. In some embodiments, the anti-PDL1 antibody, conjugated anti-PDL1 antibody, activatable anti-PDL1 antibody and/or conjugated activatable anti-PDL1 antibody and the additional agent(s) are administered sequentially.

The invention also provides methods and kits for using the activatable anti-PDL1 antibodies and/or conjugated activatable anti-PDL1 antibodies in a variety of diagnostic and/or prophylactic indications. For example, the invention provides methods and kits for detecting the presence or absence of a cleaving agent and a target of interest in a subject or a sample by (i) contacting a subject or sample with an anti-PDL1 activatable antibody, wherein the anti-PDL1 activatable antibody comprises a masking moiety (MM), a cleavable moiety (CM) that is cleaved by the cleaving agent, and an antigen binding domain or fragment thereof (AB) that specifically binds the target of interest, wherein the anti-PDL1 activatable antibody in an uncleaved, non-activated state comprises a structural arrangement from N-terminus to C-terminus as follows: MM-CM-AB or AB-CM-MM; (a) wherein the MM is a peptide that inhibits binding of the AB to PDL1, and wherein the MM does not have an amino acid sequence of a naturally occurring binding partner of the AB and is not a modified form of a natural binding partner of the AB; and (b) wherein, when the AB is in an uncleaved, non-activated state, the MM interferes with specific binding of the AB to PDL1, and when the AB is in a cleaved, activated state the MM does not interfere or compete with specific binding of the AB to PDL1; and (ii) measuring a level of activated anti-PDL1 activatable antibody in the subject or sample, wherein a detectable level of activated anti-PDL1 activatable antibody in the subject or sample indicates that the cleaving agent and PDL1 are present in the subject or sample and wherein no detectable level of activated anti-PDL1 activatable antibody in the subject or sample indicates that the cleaving agent, PDL1 or both the cleaving agent and PDL1 are absent in the subject or sample.

In some embodiments, the activatable anti-PDL1 antibody is an activatable anti-PDL1 antibody to which a therapeutic agent is conjugated. In some embodiments, the activatable anti-PDL1 antibody is not conjugated to an agent. In some embodiments, the activatable anti-PDL1 antibody comprises a detectable label. In some embodiments, the detectable label is positioned on the AB. In some embodiments, measuring the level of activatable anti-PDL1 antibody in the subject or sample is accomplished using a secondary reagent that specifically binds to the activated antibody, wherein the reagent comprises a detectable label. In some embodiments, the secondary reagent is an antibody comprising a detectable label.

In some embodiments of these methods and kits, the activatable anti-PDL1 antibody includes a detectable label. In some embodiments of these methods and kits, the detectable label includes an imaging agent, a contrasting agent, an enzyme, a fluorescent label, a chromophore, a dye, one or more metal ions, or a ligand-based label. In some embodiments of these methods and kits, the imaging agent comprises a radioisotope. In some embodiments of these methods and kits, the radioisotope is indium or technetium. In some embodiments of these methods and kits, the contrasting agent comprises iodine, gadolinium or iron oxide. In some embodiments of these methods and kits, the enzyme comprises horseradish peroxidase, alkaline phosphatase, or β-galactosidase. In some embodiments of these methods and kits, the fluorescent label comprises yellow fluorescent protein (YFP), cyan fluorescent protein (CFP), green fluorescent protein (GFP), modified red fluorescent protein (mRFP), red fluorescent protein tdimer2 (RFP tdimer2), HCRED, or a europium derivative. In some embodiments of these methods and kits, the luminescent label comprises an N-methylacrydium derivative. In some embodiments of these methods, the label comprises an Alexa Fluor® label, such as Alex Fluor® 680 or Alexa Fluor® 750. In some embodiments of these methods and kits, the ligand-based label comprises biotin, avidin, streptavidin or one or more haptens.

In some embodiments of these methods and kits, the subject is a mammal. In some embodiments of these methods, the subject is a human. In some embodiments, the subject is a non-human mammal, such as a non-human primate, companion animal (e.g., cat, dog, horse), farm animal, work animal, or zoo animal. In some embodiments, the subject is a rodent.

In some embodiments of these methods and kits, the method is an in vivo method. In some embodiments of these methods, the method is an in situ method. In some embodiments of these methods, the method is an ex vivo method. In some embodiments of these methods, the method is an in vitro method.

In some embodiments of the methods and kits, the method is used to identify or otherwise refine a patient population suitable for treatment with an anti-PDL1 activatable antibody of the disclosure, followed by treatment by administering that activatable anti-PDL1 antibody and/or conjugated activatable anti-PDL1 antibody to a subject in need thereof. For example, patients that test positive for both the target (e.g., PDL1) and a protease that cleaves the substrate in the cleavable moiety (CM) of the anti-PDL1 activatable antibody being tested in these methods are identified as suitable candidates for treatment with such an anti-PDL1 activatable antibody comprising such a CM, and the patient is then administered a therapeutically effective amount of the activatable anti-PDL1 antibody and/or conjugated activatable anti-PDL1 antibody that was tested. Likewise, patients that test negative for either or both of the target (e.g., PDL1) and the protease that cleaves the substrate in the CM in the activatable antibody being tested using these methods might be identified as suitable candidates for another form of therapy. In some embodiments, such patients can be tested with other anti-PDL1 activatable antibodies until a suitable anti-PDL1 activatable antibody for treatment is identified (e.g., an anti-PDL1 activatable antibody comprising a CM that is cleaved by the patient at the site of disease). In some embodiments, the patient is then administered a therapeutically effective amount of the activatable anti-PDL1 antibody and/or conjugated for which the patient tested positive. Suitable AB, MM, and/or CM include any of the AB, MM, and/or CM disclosed herein.

Pharmaceutical compositions according to the invention can include an antibody of the invention and a carrier. These pharmaceutical compositions can be included in kits, such as, for example, diagnostic kits.

BRIEF DESCRIPTION OF THE DRAWINGS

FIGS. 9A-9C show that both anti-PDL1 antibodies C5H9 and C5H9v2 bind human, mouse and cyno PDL1 with near equal affinities.

FIG. 10A demonstrates that anti-PDL1 antibody C5H9v2 binds only to human and mouse PDL1 demonstrating specificity toward PDL1.

FIG. 11 demonstrates that both anti-PDL1 antibody C5H9 and anti-PDL1 antibody C5H9v2 are potent blockers of either B7-1 or PD1 binding to PDL1, and that blockade includes all three species human, cyno and mouse with single digit nM $EC_{50}$'s.

DETAILED DESCRIPTION OF THE INVENTION

Figure 1:
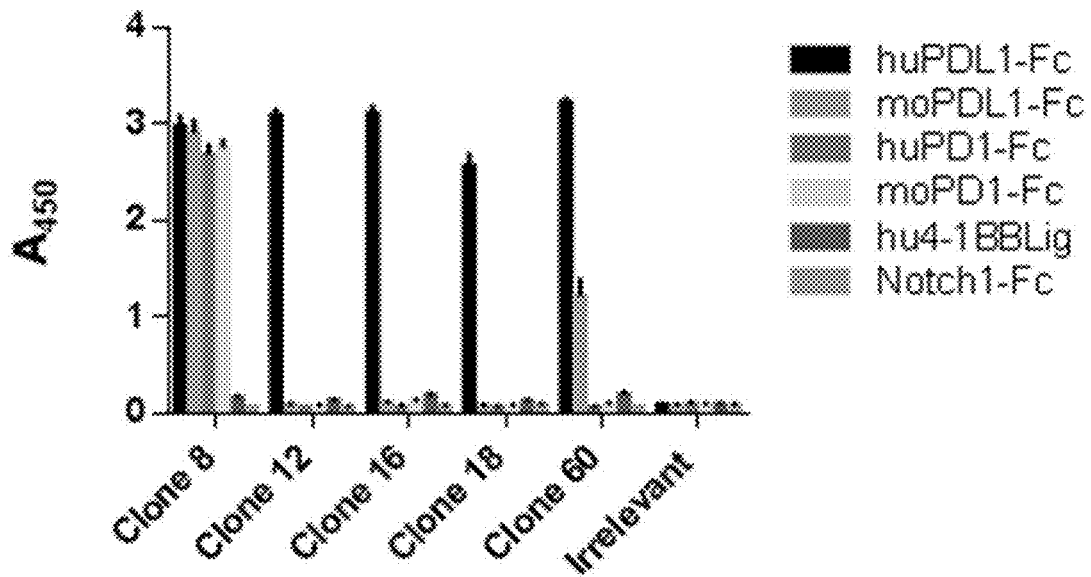
FIG. 1 is graph depicting by ELISA-based binding that PDL1c60 ScFv-phage binds specifically to human and mouse PDL1.

The present invention provides monoclonal antibodies (mAbs) and activatable monoclonal antibodies that specifically bind human programmed death ligand 1 (PDL1). PDL1 is a 40 kDa type I transmembrane protein that forms a complex with its receptor programmed cell death protein 1 (PD1), also known as CD279. Engagement of PDL1 with its receptor PD1 on T cells delivers a signal that inhibits TCR-mediated activation of IL-2 production and T cell proliferation. Aberrant expression and/or activity of PDL1 and PDL1-related signaling has been implicated in the pathogenesis of many diseases and disorders, such as cancer, inflammation, and autoimmunity.

The activatable anti-PDL1 antibodies are used in methods of treating, preventing, delaying the progression of, ameliorating and/or alleviating a symptom of a disease or disorder associated with aberrant PDL1 expression and/or activity. For example, the activatable anti-PDL1 antibodies are used in methods of treating, preventing, delaying the progression of, ameliorating and/or alleviating a symptom of a cancer or other neoplastic condition.

The activatable anti-PDL1 antibodies include an antibody or antigen-binding fragment thereof that specifically binds PDL1 coupled to a masking moiety (MM), such that coupling of the MM reduces the ability of the antibody or antigen-binding fragment thereof to bind PDL1. In some embodiments, the MM is coupled via a sequence that includes a substrate for a protease, for example, a protease that is co-localized with PDL1 at a treatment site in a subject.

Exemplary activatable anti-PDL1 antibodies of the invention include, for example, activatable antibodies that include a heavy chain and a light chain that are, or are derived from, antibodies described in the Examples, for example in Example 3 and Example 4.

In some embodiments, the activatable anti-PDL1 antibody includes a heavy chain that comprises or is derived from an amino acid sequence selected from the group consisting of SEQ ID NO: 14, 16, 18, 20, 22, 24, 26, 28, 30, 32, 34, 36, 38, 40, 42, 44, 46, 48, 50, 52, 54, and 56, and a light chain that comprises or is derived from the amino acid sequence of SEQ ID NO: 12 or SEQ ID NO: 58.

In some embodiments, the activatable anti-PDL1 antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 15; a VH CDR2 sequence shown in Table 15; a VH CDR3 sequence shown in Table 15; a VL CDR1 sequence shown in Table 15; a VL CDR2 sequence shown in Table 15; and a VL CDR3 sequence shown in Table 15.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 15.

In some embodiments, the antibody comprises a heavy chain that comprise a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 15.

In some embodiments, the antibody comprises a light chain that comprise a combination of a VL CDR1 sequence, a VL CDR2 sequence, and a VL CDR3 sequence, wherein the combination is a combination of the three light chain CDR sequences (VL CDR1, VL CDR2, VL CDR3) shown in a single row in Table 15.

In some embodiments, the activatable anti-PDL1 antibody includes a heavy chain that comprises or is derived from a heavy chain amino acid sequence shown in Table 15. In some embodiments, the activatable anti-PDL1 antibody includes a light chain that comprises or is derived from a light chain amino acid sequence shown in Table 15. In some embodiments, the activatable anti-PDL1 antibody includes a heavy chain that comprises or is derived from a heavy chain amino acid sequence shown in Table 15, and a light chain that comprises or is derived from a light chain amino acid sequence shown in Table 15. In some embodiments, the activatable anti-PDL1 antibody includes a combination of heavy chain variable region and light chain variable region sequences from the combinations shown in Group A in Table 15. In some embodiments, the activatable anti-PDL1 antibody includes the combination of heavy chain variable region and light chain variable region sequences shown in Group B in Table 15. In some embodiments, the activatable anti-PDL1 antibody includes the combination of heavy chain variable region and light chain variable region sequences shown in Group C in Table 15. In some embodiments, the activatable anti-PDL1 antibody includes the combination of heavy chain variable region and light chain variable region sequences shown in Group D in Table 15. In some embodiments, the activatable anti-PDL1 antibody includes the combination of heavy chain variable region and light chain variable region sequences shown in Group E in Table 15. In some embodiments, the activatable anti-PDL1 antibody includes the combination of heavy chain variable region and light chain variable region sequences shown in Group F in Table 15. In some embodiments, the activatable anti-PDL1 antibody includes the combination of heavy chain variable region and light chain variable region sequences shown in Group G in Table 15. In some embodiments, the activatable anti-PDL1 antibody includes the combination of heavy chain variable region and light chain variable region sequences shown in Group H in Table 15. In some embodiments, the activatable anti-PDL1 antibody includes the combination of heavy chain variable region and light chain variable region sequences shown in Group I in Table 15. In some embodiments, the activatable anti-PDL1 antibody includes the combination of heavy chain and light chain sequences shown in Group J in Table 15. In some embodiments, the activatable anti-PDL1 antibody includes the combination of heavy chain variable region and light chain variable region sequences shown in Group K in Table 15. In some embodiments, the activatable anti-PDL1 antibody includes the combination of heavy chain and light chain sequences shown in Group K in Table 15. In some embodiments, the activatable anti-PDL1 antibody includes the combination of heavy chain variable region and light chain variable region sequences shown in Group L in Table 15. In some embodiments, the activatable anti-PDL1 antibody includes the combination of heavy chain variable region and light chain variable region sequences shown in Group M in Table 15. In some embodiments, the activatable anti-PDL1 antibody includes the combination of heavy chain variable region and light chain variable region sequences shown in Group N in Table 15. In some embodiments, the activatable anti-PDL1 antibody includes the combination of heavy chain variable region and light chain variable region sequences shown in Group 0 in Table 15.

TABLE 15

Variable Heavy Chain Region (VH) and Variable Light Chain Region (VL) Sequences for Activatable Antibodies that Bind PDL1 (CDR sequences are underlined; CDR sequences disclosed herein were identified in accordance with the definitions of Kabat, Sequences of Proteins of Immunological Interest (National Institutes of Health, Bethesda, Md. (1987 and 1991)))

Group A

VH QVQLVQSGAEVKKPGASVKVSCKASGYTFT<u>DYGFS</u>WVRQAPGQGLEWMG<u>WITAYNGNTNYAQKLQG</u>RVTMTT
DTSTSTVYMELRSLRSDDTAVYYCAR<u>DYFYGMDV</u>WGQGTTVTVSS (SEQ ID NO: 248)

VH QVQLVQSGAEVKKPGSSVKVSCKTSGDTFS<u>TYAIS</u>WVRQAPGQGLEWMG<u>GIIPIFGKAHYAQKFQG</u>RVTITA
DESTSTAYMELSSLRSEDTAVYFCAR<u>KFHFVSGSPFGMDV</u>WGQGTTVTVSS (SEQ ID NO: 249)

VH QVQLVQSGAEVKKPGASVKVSCKASGYTFT<u>SYDVH</u>WVRQAPGQRLEWMG<u>WLHADTGITKFSQKFQG</u>RVTITR
DTSASTAYMELSSLRSEDTAVYYCAR<u>ERIQLWFDY</u>WGQGT (SEQ ID NO: 250)

VH QVQLVQSGAEVKKPGSSVKVSCKVSGGIFS<u>TYAIN</u>WVRQAPGQGLEWMG<u>GIIPIFGTANHAQKFQG</u>RVTITA
DESTSTAYMELSSLRSEDTAVYYCAR<u>DQGIAAALFDY</u>WGQGTLVTVSS (SEQ ID NO: 251)

VH EVQLVESGGGLVQPGRSLRLSCAVSGFTFD<u>DYVVH</u>WVRQAPGKGLEWVS<u>GNSGNIGYADSVKG</u>RFTISRDNA
KNSLYLQMNSLRAEDTALYYCAV<u>PFDY</u>WGQGTLVTVSS (SEQ ID NO: 252)

VH QVQLVQSGAEVKKPGSSVKVSCKTSGDTFS<u>SYAIS</u>WVRQAPGQGLEWMG<u>GIIPIFGRAHYAQKFQG</u>RVTITA
DESTSTAYMELSSLRSEDTAVYFCAR<u>KFHFVSGSPFGMDV</u>WGQGTTVTVSS (SEQ ID NO: 253)

VH QVQLVQSGAEVKKPGSSVKVSCKTSGGTFS<u>SYAIS</u>WVRQAPGQGLEWMG<u>GIIPIFGKAHYAQKFQG</u>RVTITA
DESTTTAYMELSSLRSEDTAVYYCAR<u>KYDYVSGSPFGMDV</u>WGQGTTVTVSS (SEQ ID NO: 254)

VH QVQLVQSGAEVKKPGSSVKVSCKASGGTFS<u>SYAIN</u>WVRQAPGQGLEWMG<u>GIIPIFGSANYAQKFQD</u>RVTITA
DESTSAAYMELSSLRSEDTAVYYCAR<u>DSSGWSRYYMDV</u>WGQGTTVTVSS (SEQ ID NO: 255)

VH QVQLVQSGAEVKEPGSSVKVSCKASGGTFN<u>SYAIS</u>WVRQAPGQGLEWMG<u>GIIPLFGIAHYAQKFQG</u>RVTITA
DESTNTAYMDLSSLRSEDTAVYYCAR<u>KYSYSGSPFGMDV</u>WGQGTTVTVSS (SEQ ID NO: 256)

VH EVQLVESGGGLVQPGRSLRLSCARSGITFD<u>DYGMH</u>WVRQAPGKGLEWVS<u>GISWNRGRIEYADSVKG</u>RFTISR
DNAKNSLYLQMNSLRAEDTALYYCAK<u>GRFRYFDWFLDY</u>WGQGTLVTVSS (SEQ ID NO: 257)

VH QMQLVQSGGGLVQPGGSLRLSCAASGFTFS<u>SYWMS</u>WVRQAPGKGLEWVA<u>NIKQDGSEKYYVDSVKG</u>RFTISR
DNAKNSLYLQMNSLRAEDTAVYYCAR<u>DYFWSGESAFDI</u>WGKGTLVTVS (SEQ ID NO: 449)

VL EIVLTQSPATLSLSPGERATLSC<u>RASQSVSSYLV</u>WYQQKPGQAPRLLIY<u>DASNRAT</u>GIPARFSGSGSGTDFT
LTISSLEPEDFAVYYC<u>QQRSNWPRT</u>FGQGTKVEIK (SEQ ID NO: 258)

VL EIVLTQSPATLSLSPGERATLSC<u>RASQSVSSYLA</u>WYQQKPGQAPRLLIY<u>DASNRAT</u>GIPARFSGSGSGTDFT
LTISSLEPEDFAVYYC<u>QQRSNWPT</u>FGQGTKVEIK (SEQ ID NO: 259)

VL DIQMTQSDSSLSASVGDRVTITC<u>RASQGISSWLA</u>WYQQKPEKAPKSLIY<u>AASSLQS</u>GVPSRFSGSGSGTDFT
LTISSLQPEDFATYYC<u>QQYNSYPYT</u>FGQGTKLEIK (SEQ ID NO: 260)

VL EIVLTQSPGTLSLSPGERATLSC<u>RASQSVSSSYLA</u>WYQQKPGQAPRLLIY<u>GASSRAT</u>GIPDRFSGSGSGTDF
TLTISRLEPEDFAVYYC<u>QQYGSSPWT</u>FGQGTKVEIK (SEQ ID NO: 261)

VL EIVLTQSPGTLSLSPGERATLSC<u>RASQSVSSSYLA</u>WYQQKPGQAPRLLIY<u>GASSRAT</u>GIPDRFSGSGSGTDF
TLTISRLEPEDFAVYYC<u>QQYGSSPF</u>GGGTKVEIK (SEQ ID NO: 262)

VL EIVLTQSPATLSLSPGERATLSC<u>RASQSVSSYLA</u>WYQQKPGQAPRLLIY<u>DASNRAT</u>GIPARFSGSGSGTDFT
LTISSLEPEDFAVYYC<u>QQRSNWPT</u>FGQGTRLEIK (SEQ ID NO: 263)

VL AIQLTQSESSLSASVGDRVTITC<u>RASQGISSALA</u>WYQQKPGKAPKLLIY<u>DASSLES</u>GVPSRFSGSGSGTDFT
LTISSLQPEDFATYYC<u>QQFNSYPFT</u>FGPGTKVDIK (SEQ ID NO: 264)

DIVMTQSPSTLSASVGDRVTITCRASQGISSWLAWYQQKPGRAPKVLIYKASTLESGVPSRFSGSGSGTDFT
LTISSLQPEDFATYYCQQSYSTPWTFGQGTKLEIK (SEQ ID NO: 450)

Group B

VH EVQLVESGGGLVQPGGSLRLSCAASGFTFS<u>RYWMS</u>WVRQAPGKGLEWVA<u>NIKQDGSEKYYVDSVKG</u>RFTISR
DNAKNSLYLQMNSLRAEDTAVYYCAR<u>EGGWFGELAFDY</u>WGQGTLVTVSS (SEQ ID NO: 265)

VL EIVLTQSPGTLSLSDGERATLSC<u>RASQRVSSSYLA</u>WYQQKPGQAPRLLIY<u>DASSRAT</u>GIPDRFSGSGSGTDF
TLTISRLEPEDFAVYYC<u>QQYGSLPWT</u>FGQGTKVEIK (SEQ ID NO: 266)

Group C

VH EVQLVESGGGLVQPGGSLRLSCAAS<u>GFTFSDSWIH</u>WVRQAPGKGLEWVA<u>WISPYGGSTYYADSVKG</u>RFTISA
DTSKNTAYLQMNSLRAEDTAVYYCAR<u>RHWPGGFDY</u>WGQGTLVTVSA (SEQ ID NO: 267)

VH EVQLVESGGGLVQPGGSLRLSCAASGFTFSGSWIHWVRQAPGKGLEWVAWILPYGGSSYYADSVKGRFTISA
DTSKNTAYLQMNSLRAEDTAVYYCARRHWPGGFDYWGQGTLVTVSA (SEQ ID NO: 451)

TABLE 15-continued

Variable Heavy Chain Region (VH) and Variable Light Chain Region (VL) Sequences for Activatable Antibodies that Bind PDL1 (CDR sequences are underlined; CDR sequences disclosed herein were identified in accordance with the definitions of Kabat, Sequences of Proteins of Immunological Interest (National Institutes of Health, Bethesda, Md. (1987 and 1991)))

VL DIQMTQSPSSLSASVGDRVTITC<u>RASQDVSTAVA</u>WYQQKPGKAPKLLIY<u>SASFLYS</u>GVPSRFSGSGSGTDFT
LTISSLQPEDFATYYC<u>QQYLYHPAT</u>FGQGTKVEIKR (SEQ ID NO: 268)

VL DIQMTQSPSSLSASVGDRVTITCRASQDVSTAVAWYQQKPGKAPKLLIYSASFLYSGVPSRFSGSGSGTDFT
LTISSLQPEDFATYYCQQYYNVPWTFGQGTKVEIKR (SEQ ID NO: 452)

VL DIQMTQSPSSLSASVGDRVTITCRASQDVSTAVAWYQQKPGKAPKLLIYSASFLYSGVPSRFSGSGSGTDFT
LTISSLQPEDFATYYCQQYYAPPWTFGQGTKVEIKR (SEQ ID NO: 453)

VL DIQMTQSPSSLSASVGDRVTITCRASQDVSTAVAWYQQKPGKAPKLLIYSASFLYSGVPSRFSGSGSGTDFT
LTISSLQPEDFATYYCQQYYTVPWTFGQGTKVEIKR (SEQ ID NO: 454)

VL DIQMTQSPSSLSASVGDRVTITCRASQVINTFLAWYQQKPGKAPKLLIYSASTLASGVPSRFSGSGSGTDFT
LTISSLQPEDFATYYCQQYYTVPRTFGQGTKVEIKR (SEQ ID NO: 455)

VL DIQMTQSPSSLSASVGDRVTITCRASQDVSTAVAWYQQKPGKAPKLLIYSASFLYSGVPSRFSGSGSGTDFT
LTISSLQPEDFATYYCQQGYGVPRTFGQGTKVEIKR (SEQ ID NO: 456)

VL DIQMTQSPSSLSASVGDRVTITCRASQDVSTAVAWYQQKPGKAPKLLIYSASFLYSGVPSRFSGSGSGTDFT
LTISSLQPEDFATYYCQQYLFTPPTFGQGTKVEIKR (SEQ ID NO: 457)

VL DIQMTQSPSSLSASVGDRVTITCRASQDVSTAVAWYQQKPGKAPKLLIYSASFLYSGVPSRFSGSGSGTDFT
LTISSLQPEDFATYYCQQYFITPTTFGQGTKVEIKR (SEQ ID NO: 458)

VL DIQMTQSPSSLSASVGDRVTITCRASQDVSTAVAWYQQKPGKAPKLLIYSASFLYSGVPSRFSGSGSGTDFT
LTISSLQPEDFATYYCQQYYYTPPTFGQGTKVEIKR (SEQ ID NO: 459)

VL DIQMTQSPSSLSASVGDRVTITCRASQDVSTAVAWYQQKPGKAPKLLIYSASFLYSGVPSRFSGSGSGTDFT
LTISSLQPEDFATYYCQQFFYTPPTFGQGTKVEIKR (SEQ ID NO: 460)

VL DIQMTQSPSSLSASVGDRVTITCRASQDVSTAVAWYQQKPGKAPKLLIYSASFLYSGVPSRFSGSGSGTDFT
LTISSLQPEDFATYYCQQSLFTPPTFGQGTKVEIKR (SEQ ID NO: 461)

VL DIQMTQSPSSLSASVGDRVTITCRASQDVSTAVAWYQQKPGKAPKLLIYSASFLYSGVPSRFSGSGSGTDFT
LTISSLQPEDFATYYCQQSLYTPPTFGQGTKVEIKR (SEQ ID NO: 462)

VL DIQMTQSPSSLSASVGDRVTITCRASQDVSTAVAWYQQKPGKAPKLLIYSASFLYSGVPSRFSGSGSGTDFT
LTISSLQPEDFATYYCQQSWYHPPTFGQGTKVEIKR (SEQ ID NO: 463)

VL DIQMTQSPSSLSASVGDRVTITCRASQDVSTAVAWYQQKPGKAPKLLIYSRSFLYSGVPSRFSGSGSGTDFT
LTISSLQPEDFATYYCQQYFYIPPTFGQGTKVEIKR (SEQ ID NO: 464)

VL DIQMTQSPSSLSASVGDRVTITCRASQDVSTAVAWYQQKPGKAPKLLIYSASFLYSGVPSRFSGSGSGTDFT
LTISSLQPEDFATYYCQQYWYTPTTFGQGTKVEIKR (SEQ ID NO: 465)

VL DIQMTQSPSSLSASVGDRVTITCRASQDVSTAVAWYQQKPGKAPKLLIYSASFLYSGVPSRFSGSGSGTDFT
LTISSLQPEDFATYYCQQSYFIPPTFGQGTKVEIKR (SEQ ID NO: 466)

Group D

VH METGLRWLLLVAVLKGVQCLSVEESGGRLVTPGTPLTLTCTASGFTITNYHMFWVRQAPGKGLEWIGVITSS
GIGSSSTTYYATWAKGRFTISKTSTTVNLRITSPTTEDTATYFCARDYFTNTYYALDIWGPGTLVTVSS
(SEQ ID NO: 467)

VH QVQLVQSGAEVKKPGSSVKVSCKTSGDTFS<u>TYAIS</u>WVRQAPGQGLEWMG<u>GIIPIFGKAHYAQKFQG</u>RVTITA
DESTSTAYMELSSLRSEDTAVFCAR<u>KFHFVSGSPFGMDV</u>WGQGTTVTVSS (SEQ ID NO: 249)

VH QVQLVQSGAEVKKPGASVKVSCKASGYTFT<u>SYDVH</u>WVRQAPGQRLEWMG<u>WLHADTGITKFSQKFQG</u>RVTITR
DTSASTAYMELSSLRSEDTAVYYCAR<u>ERIQLWFDY</u>WGQGTLVTVSS (SEQ ID NO: 468)

VH QVQLVQSGAEVKKPGSSVKVSCKVSGGIFS<u>TYAIN</u>WVRQAPGQGLEWMG<u>GIIPIFGTANHAQKFQG</u>RVTITA
DESTSTAYMELSSLRSEDTAVYYCAR<u>DQGIAAALFDY</u>WGQGTLVTVSS (SEQ ID NO: 251)

VH EVQLVESGGGLVQPGRSLRLSCAVSGFTFD<u>DYVVH</u>WVRQAPGKGLEWVS<u>GISGNSGNIGYADSVKG</u>RFTISR
DNAKNSLYLQMNSLRAEDTALYYCAV<u>PFDY</u>WGQGTLVTVSS (SEQ ID NO: 469)

VH QVQLVQSGAEVKKPGSSVKVSCKTSGDTFS<u>SYAIS</u>WVRQAPGQGLEWMG<u>GIIPIFGRAHYAQKFQG</u>RVTITA
DESTSTAYMELSSLRSEDTAVYFCAR<u>KFHFVSGSPFGMDV</u>WGQGTTVTVSS (SEQ ID NO: 253)

VH QVQLVQSGAEVKKPGSSVKVSCKTSGGTFS<u>SYAIS</u>WVRQAPGQGLEWMG<u>GIIPIFGKAHYAQKFQG</u>RVTITA
DESTTTAYMELSSLRSEDTAVYYCAR<u>KYDYVSGSPFGMDV</u>WGQGTTVTVSS (SEQ ID NO: 254)

TABLE 15-continued

Variable Heavy Chain Region (VH) and Variable Light Chain Region (VL) Sequences for Activatable Antibodies that Bind PDL1 (CDR sequences are underlined; CDR sequences disclosed herein were identified in accordance with the definitions of Kabat, Sequences of Proteins of Immunological Interest (National Institutes of Health, Bethesda, Md. (1987 and 1991)))

VH  QVQLVQSGAEVKKPGSSVKVSCKASGGTFS<u>SYAIN</u>WVRQAPGQGLEWMG<u>GIIPIFGSANYAQKFQD</u>RVTITA
    DESTSAAYMELSSLRSEDTAVYYCAR<u>DSSGWSRYYMDV</u>WGQGTTVTVSS (SEQ ID NO: 255)

VH  QVQLVQSGAEVKEPGSSVKVSCKASGGTFN<u>SYAIS</u>WVRQAPGQGLEWMG<u>GIIPLFGIAHYAQKFQG</u>RVTITA
    DESTNTAYMDLSSLRSEDTAVYYCAR<u>KYSYVSGSPFGMDV</u>WGQGTTVTVSS (SEQ ID NO: 256)

VH  EVQLVESGGGLVQPGRSLRLSCAASGITFD<u>DYGMH</u>WVRQAPGKGLEWVS<u>GISWNRGRIEYADSVKG</u>RFTISR
    DNAKNSLYLQMNSLRAEDTALYYCAK<u>GRFRYFDWFLDY</u>WGQGTLVTVSS (SEQ ID NO: 257)

VL  MDTRAPTQLLGLLLLWLPGARCALVMTQTPSSTSTAVGGTVTIKC<u>QASQSISVYLA</u>WYQQKPGQPPKLLIYS
    ASTLASGVPSRFKGSRSGTEYTLTISGVQREDAATYYC<u>LGSAGS</u> (SEQ ID NO: 470)

VL  EIVLTQSPATLSLSPGERATLSC<u>RASQSVSSYLV</u>WYQQKPGQAPRLLIY<u>DASNRAT</u>GIPARFSGSGSGTDFT
    LTISSLEPEDFAVYYC<u>QQRSNWPRT</u>FGQGTKVEIK (SEQ ID NO: 258)

VL  EIVLTQSPATLSLSPGERATLSC<u>RASQSVSSYLA</u>WYQQKPGQAPRLLIY<u>DASNRAT</u>GIPARFSGSGSGTDFT
    LTISSLEPEDFAVYYC<u>QQRSNWPT</u>FGQGTKVEIK (SEQ ID NO: 259)

VL  DIQMTQSPSSLSASVGDRVTITC<u>RASQGISSWLA</u>WYQQKPEKAPKSLIY<u>AASSLQS</u>GVPSRFSGSGSGTDFT
    LTISSLQPEDFATYYC<u>QQYNSYPYT</u>FGQGTKLEIK (SEQ ID NO: 260)

VL  EIVLTQSPGTLSLSPGERATLSC<u>RASQSVSSSYLA</u>WYQQKPGQAPRLLIY<u>GASSRAT</u>GIPDRFSGSGSGTDF
    TLTISRLEPEDFAVYYC<u>QQYGSSPWT</u>FGQGTKVEIK (SEQ ID NO: 261)

VL  EIVLTQSPGTLSLSPGERATLSC<u>RASQSVSSSYLA</u>WYQQKPGQAPRLLIY<u>GASSRAT</u>GIPDRFSGSGSGTDF
    TLTISRLEPEDFAVYYC<u>QQYGSSPF</u>GGGTKVEIK (SEQ ID NO: 262)

VL  EIVLTQSPATLSLSPGERATLSC<u>RASQSVSSYLA</u>WYQQKPGQAPRLLIY<u>DASNRAT</u>GIPARFSGSGSGTDFT
    LTISSLEPEDFAVYYC<u>QQRSNWPT</u>FGQGTRLEIK (SEQ ID NO: 263)

VL  AIQLTQSPSSLSASVGDRVTITC<u>RASQGISSALA</u>WYQQKPGKAPKLLIY<u>DASSLES</u>GVPSRFSGSGSGTDFT
    LTISSLQPEDFATYYC<u>QQFNSYPFT</u>FGPGTKVDIK (SEQ ID NO: 264)

Group E

VH  EVQLLESGGGLVQPGGSLRLSCAASGFTFS<u>SYIMM</u>WVRQAPGKGLEWVS<u>SIYPSGGITFYADTVKG</u>RFTISR
    DNSKNTLYLQMNSLRAEDTAVYYCAR<u>IKLGTVTTVDY</u>WGQGTLVTVSS (SEQ ID NO: 471)

VL  QSALTQPASVSGSPGQSITISC<u>TGTSSDVGGYNYVS</u>WYQQHPGKAPKLMIY<u>DVSNRPS</u>GVSNRFSGSKSGNT
    ASLTISGLQAEDEADYYC<u>SSYTSSSTRV</u>FGTGTKVTVL (SEQ ID NO: 472)

Group F

VH  EVKLQESGPSLVKPSQTLSLTCSVT<u>GYSITSDYWN</u>WIRKFPGNKLEYVG<u>YISYTGSTYYNPSLKS</u>RISITRD
    TSKNQYYLQLNSVTSEDTATYYCAR<u>YGGWLSPFDY</u>WGQGTTLTVSS (SEQ ID NO: 473)

VH  EVQLQESGPGLVAPSQSLSITCTVS<u>GFSLTTYSIN</u>WIRQPPGKGLEWLGV<u>MWAGGGTNSNSVLKS</u>RLIISKD
    NSKSQVFLKMNSLQTDDTARYYCAR<u>YYGNSPYYAID</u>YWGQGTSVTSS (SEQ ID NO: 474)

VH  EVKLQESGPSLVKPSQTLSLTCSVT<u>GYSIISDYWN</u>WIRKFPGNKLEYLG<u>YISYTGSTYYKPSLKS</u>RISITRD
    TSKNQYYLQLNSVTTEDTATYYCAR<u>RGGWLLPFDY</u>WGQGTTLTVSS (SEQ ID NO: 475)

VH  EVKLQESGPSLVKPGASVKLSCKAS<u>GYTFTSYDIN</u>WVKQRPGQGLEWIG<u>WIFPRDNNTKYKENFKG</u>KATLTV
    DTSSTTAYMELHSLTSEDSAVYFCT<u>KENWVGDF</u>DYWGQGTTLTLSS (SEQ ID NO: 476)

VH  EVQLQQSGPDLVTPGASVRISCQAS<u>GYTFPDYYMN</u>WVKQSHGKSLEWIG<u>DIDPNYGGTTYNQKFKG</u>KAILTV
    DRSSSTAYMELRSLTSEDSAVYYCAR<u>GAL</u>TDWGQGTSLTVSS (SEQ ID NO: 477)

VH  EIVLTQSPATLSLSPGERATLSC<u>RASSSVSYIY</u>WFQQKPGQSPRPLIYAAFNRATGIPARFSGSGSGTDYTL
    TISSLEPEDFAVYYCQQWSNNPLTFGQGTKVEIK (SEQ ID NO: 478)

VH  QVQLVQSGAEVKKPGASVKVSCKAS<u>GYTFPDYYMN</u>WVRQAPGQGLEWMGDIDPNYGGTNYAQKFQGRVTMTR
    DTSISTAYMELSRLRSDDTAVYYCAR<u>GAL</u>TDWGQGTMVTVSS (SEQ ID NO: 479)

VH  QVQLVQSGAEVKKPGASVKVSCKAS<u>GYTFPDYYMN</u>WVRQAPGQSLEWMGDIDPNYGGTNYNQKFQGRVTMTR
    DTSISTAYMELSRLRSDDTAVYYCAR<u>GAL</u>TDWGQGTMVTVSS (SEQ ID NO: 480)

VH  EVQLVQSGAEVKKPGASVKVSCKAS<u>GYTFPDYYMN</u>WVRQAPGQSLEWMGDIDPNYGGTNYNQKFQGRVTMTV
    DRSSSTAYMELSRLRSDDTAVYYCAR<u>GAL</u>TDWGQGTMVTVSS (SEQ ID NO: 481)

VH  EVQLVESGGGLVQPGRSLRLSCTAS<u>GYTFPDYYMN</u>WVRQAPGKGLEWVGDIDPNYGGTTYAASVKGRFTISV
    DRSKSIAYLQMSSLKTEDTAVYYCTR<u>GAL</u>TDWGQGTMVTVSS (SEQ ID NO: 482)

TABLE 15-continued

Variable Heavy Chain Region (VH) and Variable Light Chain Region (VL) Sequences for Activatable Antibodies that Bind PDL1 (CDR sequences are underlined; CDR sequences disclosed herein were identified in accordance with the definitions of Kabat, Sequences of Proteins of Immunological Interest (National Institutes of Health, Bethesda, Md. (1987 and 1991)))

VH EVQLVESGGGLVQPGRSLRLSCTAS<u>GYTFPDYYMN</u>WVRQAPGKGLEWVGDIDPNYGGTTYNASVKGRFTISV
DRSKSIAYLQMSSLKTEDTAVYYCAR<u>GALT</u>DWGQGTMVTVSS (SEQ ID NO: 483)

VL DIVMTQSHKLMSTSVGDRVSITC<u>KASQDVGTAVA</u>WYQQKPGQSPKLLIY<u>WASTRHT</u>GVPDRFTGSGSGTDFT
LTISNVQSEDLADYFC<u>QQDSSYPLT</u>FGAGTKVELK (SEQ ID NO: 484)

VL DIVTTQSHKLMSTSVGDRVSITC<u>KASQDVGTAVA</u>WYQQKPGQSPKLLIY<u>WASTRHT</u>GVPDRFTGSGSGTDFT
LTISNVQSEDLADYFC<u>QQDSSYPLT</u>FGAGTKVELK (SEQ ID NO: 485)

VL DIVMTQSPSSLAVSVGEKVSMG<u>CKSSQSLLYSSNQKNSL</u>AWYQQKPGQSPKLLID<u>WASTRES</u>GVPDRFTGSG
SGTDFTLTISSVKAEDLAVYYC<u>QQYYGYPLT</u>FGAGTKLELK (SEQ ID NO: 486)

VL DIVMTQSPAIMSASPGEKVTMTC<u>SASSSIRYMH</u>WYQQKPGTSPKRWIS<u>DTSKLTS</u>GVPARFSGSGSGTSYAL
TISSMEAEDAATYYC<u>HQRSSYPWT</u>FGGGTKLEIK (SEQ ID NO: 487)

VL QIVLSQSPAILSASPGEKVTMTC<u>RASSSVSYIY</u>WFQQKPGSSPKPWIY<u>ATFNLAS</u>GVPARFSGSGSGTSYSL
TISRVETEDAATYYCQQWSNNPLTFGAGTKLELK (SEQ ID NO: 488)

VL EIVLTQSPATLSLSPGERATLSC<u>RASSSVSYIY</u>WFQQKPGQAPRLLIY<u>AAFNRAT</u>GIPARFSGSGSGTDYTL
TISSLEPEDFAVYYCQQWSNNPLTFGQGTKVEIK (SEQ ID NO: 489)

VL QIVLTQSPATLSLSPGERATLSC<u>RASSSVSYIY</u>WFQQKPGQSPRPLIY<u>ATFNLAS</u>GIPARFSGSGSGTSYTL
TISRLEPSDFAVYYCQQWSNNPLTFGQGTKVEIK (SEQ ID NO: 490)

VL DIQLTQSPSSLSASVGDRVTITCRASSGVSYIYWFQQKPGKAPKLLIYAAFNLASGVPSRFSGSGSGTEYTL
TISSLQPSDFATYYCQQWSNNPLTFGQGTKVEIK (SEQ ID NO: 491)

VL DIQLTQSPSSLSASVGDRVTITCRASSGVSYIYWFQQKPGKAPKPLIYAAFNLASGVPSRFSGSGSGTEYTL
TISSLQPEDFATYYCQQWSNNPLTFGQGTKVEIK (SEQ ID NO: 492)

VL DIQLTQSPSILSASVGDRVTITC<u>RASSSVSYIY</u>WFQQKPGKAPKPLIY<u>ATFNLAS</u>GVPSRFSGSGSGTSYTL
TISSLQPEDFATYYCQQWSNNPLTFGQGTKVEIK (SEQ ID NO: 493)

Group G

VH QVQLVQSGAEVKKPGASVKVSCKASGYTFTSYGISWVRQAPGQGLEWMGWISAYNGNTNYAQKLQGRVTMTT
DTSTSTAYMELRSLRSDDTAVYYCARALPSGTILVGGWFDPWGQGTLVTVSS (SEQ ID NO: 494)

VH QVQLVQSGGGVVQPGRSLRLSCAASGFTFSSYALSWVRQAPGKGLEWVSAISGGGGSTYYADSVKGRFTISR
DNSKNTLYLQMNSLRAEDTAVYYCAKDVFPETFSMNYGMDVWGQGTLVTVSS (SEQ ID NO: 495)

VH QVQLVQSGGGVVQPGGSLRLSCAASGFTFDDYAMHWVRQAPGKGLEWVSLISGDGGSTYYADSVKGRFTISR
DNSKNSLYLQMNSLRTEDTALYYCAKVLLPCSSTSCYGSVGAFDIWGQGTTVTVSS (SEQ ID NO: 496)

VH QVQLVQSGGSVVRPGESLRLSCVASGFIFDNYDMSWVRQVPGKGLEWVSRVNWNGGSTTYADAVKGRFTISR
DNTKNSLYLQMNNLRAEDTAVYYCVREFVGAYDLWGQGTTVTVSS (SEQ ID NO: 497)

VH QVQLVQSGAEVKKPGATVKVSCKVFGDTFRGLYIHWVRQAPGQGLEWMGGIIPIFGTANYAQKFQGRVTITT
DESTSTAYMELSSLRSEDTAVYYCASGLRWGIWGWFDPWGQGTLVTVSS (SEQ ID NO: 498)

VH EVQLVQSGAELKKPGSSVKVSCKAFGGTFSDNAISWVRQAPGQGPEWMGGIIPIFGKPNYAQKFQGRVTITA
DESTSTAYMVLSSLRSEDTAVYYCARTMVRGFLGVMDVWGQGTTVTVSS (SEQ ID NO: 499)

VH QVQLVQSGGGLVQPGGSLRLSCAASGFTFSSYAMSWVRQAPGKGLEWVSAISGSGGSTYYADSVKGRFTISR
DNSKNTLYLQMNSLRAEDTAVYYCAKDQFVTIFGVPRYGMDWGQGTTVTVSS (SEQ ID NO: 500)

VH QVQLVQSGAEVKKPGSSVKVSCKASGGTF<u>SSYAIS</u>WVRQAPGQGLEWMGGIIPIFGTANYAQKFQGRVTITA
DKSTSTAYMELSSLRSEDTAVYYCARGRQMFGAGIDFWGPGTLVTVSS (SEQ ID NO: 501)

VH EVQLVESGAEVKKPGSSVKVSCKVSGGTFGTYALNWVRQAPGQGLEWMGRIVPLIGLVNYAHNFEGRISITA
DKSTGTAYMELSNLRSDDTAVYYCAREVYGGNSDYWGQGTLVTVSS (SEQ ID NO: 502)

VH QVQLVQSGGEVKKPGASVKVSCKASGYTLSSHGITWVRQAPGQGLEWMGWISAHNGHASNAQKVEDRVTMTT
DTSTNTAYMELRSLTADDTAVYYCARVHAALYYGMDVWGQGTLVTVSS (SEQ ID NO: 503)

VH QVQLQESGGGVVQPGRSLRLSCSASGFTFSRHGMHWVRQAPGKGLEWVAVISHDGSVKYYADSMKGRFSISR
DNSNNTLYLQMDSLRADDTAVYYCARGLSYQVSGWFDPWGQGTLVTVSS (SEQ ID NO: 504)

VH NFMLTQPHSVSESPGKTVTISCTRSSGSIASNYVQWYQQRPGSSPTTVIY<u>EDNQRPS</u>GVPDRFSGSIDTSSN
SASLTISGLKTKDEADYYCQSYDGITVIFGGGTKLTVL (SEQ ID NO: 505)

VH NFMLTQPHSVSGSPGKTVTLPCTRSSGSIASHYVQWYQQRPGSAPTTVIYEDNKRPSGVPDRFSGSIDSSSN
SASLSISGLKTEDEADYYCQSYDSSNRWVFGGGTKLTVL (SEQ ID NO: 506)

TABLE 15-continued

Variable Heavy Chain Region (VH) and Variable Light Chain Region (VL)
Sequences for Activatable Antibodies that Bind PDL1 (CDR sequences are
underlined; CDR sequences disclosed herein were identified in accordance with
the definitions of Kabat, Sequences of Proteins of Immunological Interest
(National Institutes of Health, Bethesda, Md. (1987 and 1991)))

VH LPVLTQPASLSASPGASASLTCTLRSGLNVGSYRIYWYQQKPGSRPQYLLNYKSDSNKQQASGVPSRFSGSK
   DASANAGILLISGLQSEDEADYYCMIWYSSAVVFGGGTKLTVL (SEQ ID NO: 507)

VL NFMLTQPHSVSESPGKTVTISCTRSSGNIASNYVQWYQQRPGSAPTTVIY<u>EDNQRPS</u>GVPDRFSGSIDSSSN
   SASLTISGLKTEDEADYYCQSYDSSNLWVFGGGTKLTVL (SEQ ID NO: 508)

VL SSELTQDPAVSVALGQTVRITCQGDSLRSYYASWYQQKPGQAPVLVIYGKNNRPSGIPDRFSGSSSGNTASL
   TITGAQAEDEADYYCNSRDSSGNHYVFGTGTKVTVL (SEQ ID NO: 509)

VL LPVLTQAPSVSVAPGKTARITCGGSDIGRKSVHWYQQKPGQAPALVIYSDRDRPSGISERFSGSNSGNTATL
   TISRVEAGDEADYYCQVWDNNSDHYVFGAGTELIVL (SEQ ID NO: 510)

VL QSALTQPASVSGSPGQSITISCTGTSSDVGGYNYVSWYQQHPGKAPKLMIYDVSNRPSGVSNRFSGSKSGNT
   ASLTISGLQAEDEADYYCSSYTSSTLPFGGGTKLTVL (SEQ ID NO: 511)

VL EIVLTQSPATLSLSPGERATLSCRASQSIGNSLAWYQQKPGQAPRLLMYGASSRATGIPDRFSGSGAGTDFT
   LTISSLEPEDFATYYCQQHTIPTFSFGPGTKVEVK (SEQ ID NO: 512)

VL DIVMTQTPSFLSASIGDRVTITCRASQGIGSYLAWYQQRPGEAPKLLIYAASTLQSGVPSRFSGSGSGTDFT
   LTISNLQPEDFATYYCQQLNNYPITFGQGTRLEIK (SEQ ID NO: 513)

VL QSALTQPPSVSVSPGQTANIPCSGDKLGNKYAYWYQQKPGQSPVLLIYQDIKRPSRIPERFSGSNSADTATL
   TISGTQAMDEADYYCQTWDNSVVFGGGTKLTVL (SEQ ID NO: 514)

VL NFMLTQPHSVSESPGKTVTISCTRSSGSIDSNYVQWYQQRPGSAPTTVIY<u>EDNQRPS</u>GVPDRFSGSIDSSSN
   SASLTISGLKTEDEADYYCQSYDSNNRHVIFGGGTKLTVL (SEQ ID NO: 515)

VL NFMLTQPHSVSESPGKTVTISCTRSSGNIGTNYVQWYQQRPGSAPVALIYEDYRRPSGVPDRFSGSIDSSSN
   SASLIISGLKPEDEADYYCQSYHSSGWEFGGGTKLTVL (SEQ ID NO: 516)

VL QSVLTQPPSVSVAPGQTARITCGGNNIGSKGVHWYQQKPGQAPVLVVYDDSDRPSGIPERFSGSNSGNTATL
   TISRVEAGDERDYYCQVWDSSSDHWVFGGGTKLTVL (SEQ ID NO: 517)

VL NFMLTQPHSVSESPGKTVTISCTRSSGSIASNYVQWYQQRPGSAPTTVIY<u>EDNQRPS</u>GVPDRFSGSIDSSSN
   SASLTISGLKTEDEADYYCQSYDSTTPSVFGGGTKLTVL (SEQ ID NO: 518)

VL QVQLVQSGAEVKKPGASVKVSCKASGYTFTSYGISWVRQAPGQGLEWMGWTSPHNGLTAFAQILEGRVTMTT
   DTSTNTAYMELRNLTFDDTAVYFCAKVHPVFSYALDVWGQGTLVTVSS (SEQ ID NO: 519)

VL EVQLVESGAEVMNPGSSVRVSCRGSGGDFSTYAFSWVRQAPGQGLEWMGRIIPILGIANYAQKFQGRVTITA
   DKSTSTAYMELSSLRSDDTAVYYCARDGYGSDPVLWGQGTLVTVSS (SEQ ID NO: 520)

VL EVQLVQSGAEVKKPGASVKVSCKASGYTFTNYGISWVRQAPGQGLEWMGWISAYNGNTNYAQKVQGRVTMTT
   DTSTSTGYMELRSLRSDDTAVYYCARGDFRKPFDYWGQGTLVTVSS (SEQ ID NO: 521)

Group H

VH EVQLVQSGPELKKPGASVKMSCKASGYTFT<u>SYVMH</u>WVKQAPGQRLEWIG<u>YVNPFNDGTKYNEMFKG</u>RATLTS
   DKSTSTAYMELSSLRSEDSAVYYCAR<u>QAWGYP</u>WGQGTLVTVSS (SEQ ID NO: 522)

VH EVQLVQSGAEVKKPGASVKMSCKASGYTFT<u>SYVMH</u>WVKQAPGQRLEWIG<u>YVNPFNDGTKYNEMFKG</u>RATLTS
   DKSTSTAYMELSSLRSEDTAVYYCAR<u>QAWGYP</u>WGQGTLVTVSS (SEQ ID NO: 523)

VH EVQLVQSGAEVKKPGASVKMSCKASGYTFT<u>SYVMH</u>WVRQAPGQRLEWIG<u>YVNPFNDGTKYNEMFKG</u>RATLTS
   DKSTSTAYMELSSLRSEDTAVYYCAR<u>QAWGYP</u>WGQGTLVTVSS (SEQ ID NO: 524)

VH EVQLVQSGAEVKKPGASVKVSCKASGYTFT<u>SYVMH</u>WVRQAPGQRLEWIG<u>YVNPFNDGTKYNEMFKG</u>RATLTS
   DKSTSTAYMELSSLRSEDTAVYYCAR<u>QAWGYP</u>WGQGTLVTVSS (SEQ ID NO: 525)

VH EVQLVQSGAEVKKPGASVKVSCKASGYTFT<u>SYVMH</u>WVRQAPGQRLEWIG<u>YVNPFNDGTKYNEMFKG</u>RATITS
   DKSTSTAYMELSSLRSEDTAVTYCAR<u>QAWGYP</u>WGQGTLVTVSS (SEQ ID NO: 526)

VL DIVLTQSPASLALSPGERATLSC<u>RATESVEYYGTSLVQ</u>WYQQKPGQPPKLLIY<u>AASSVDS</u>GVPSRFSGSGSG
   TDFTLTINSLEEEDAAMYFC<u>QQSRRVPYT</u>FGQGTKLEIK (SEQ ID NO: 527)

VL DIVLTQSPATLSLSPGERATLSC<u>RATESVEYYGTSLVQ</u>WYQQKPGQPPKLLIY<u>AASSVDS</u>GVPSRFSGSGSG
   TDFTLTINSLEAEDAAMYFC<u>QQSRRVPYT</u>FGQGTKLEIK (SEQ ID NO: 528)

VL EIVLTQSPATLSLSPGERATLSC<u>RATESVEYYGTSLVQ</u>WYQQKPGQPPKLLIY<u>AASSVDS</u>GVPSRFSGSGSG
   TDFTLTINSLEAEDAAMYFC<u>QQSRRVPYT</u>FGQGTKLEIK (SEQ ID NO: 529)

VL DIVLTQSPATLSLSPGERATLSC<u>RATESVEYYGTSLVQ</u>WYQQKPGQPPKLLIY<u>AASSVDS</u>GVPSRFSGSGSG
   TDFTLTINSLEAEDAATYFC<u>QQSRRVPYT</u>FGQGTKLEIK (SEQ ID NO: 530)

TABLE 15-continued

Variable Heavy Chain Region (VH) and Variable Light Chain Region (VL)
Sequences for Activatable Antibodies that Bind PDL1 (CDR sequences are
underlined; CDR sequences disclosed herein were identified in accordance with
the definitions of Kabat, Sequences of Proteins of Immunological Interest
(National Institutes of Health, Bethesda, Md. (1987 and 1991)))

Group I

VH EVQLVQSGAEVKKPGSSVKVSCKASGGTFS<u>SYAIS</u>WVRQAPGQGLEWMGGIIPIFGTANYAQKFQGRVTITA
DKSTSTAYMELSSLRSEDTAVYYCAREGTIYDSSGYSFDYWGQGTLVTVSS (SEQ ID NO: 531)

VH EVQLVQSGAEVKKPGSSVKVSCKASGGTFS<u>SYAIS</u>WVRQAPGQGLEWMGIIKPSGGSTSYAQKFQGRVSMTR
DTSTSTVYMELSSLTSEDTAVYYCARDLFPHIYGNYYGMDIWGQGTTVTVSS (SEQ ID NO: 532)

VH QVQLVQSGAEVKKPGSSVKVSCKASGGTFS<u>SYAIS</u>WVRQAPGQGLEWMGGIIPIFGTANYAQKFQGRVTITA
DKSTSTAYMELSSLRSEDTAVYYCARLAVPGAFDIWGQGTMVTVSS (SEQ ID NO: 533)

VH EVQLVESGGGVVQPGRSLRLSCAASGFTFS<u>SYAMH</u>WVRQAPGKGLAVISYDGSNKYYADSVKGRFTISRDNS
KNTLYLQMNSLRAEDTAVYYCARGQWLVTELDYWGQGTLVTVSS (SEQ ID NO: 534)

VH EVQLVESGSEVEKPGSSVKVSCKASGGTFSDSGISWVRQAPGQGLEWMGGIIPMFATPYYAQKFQDRVTITA
DESTSTVYMELSGLRSDDTAVFYCARDRGRGHLPWYFDLWGRGTLVTVSS (SEQ ID NO: 535)

VH EVQLVESGAEVKKPGSSVKVSCKASGGTFS<u>SYAIS</u>WVRQAPGQGLEWMGGIIPIFGTANYAQKFQGRVTITA
DESTSTAYMELSSLRSEDTAVYYCARAPYYYYYMDVWGQGTTVTVSS (SEQ ID NO: 536)

VH EVQLLESGAEVKKPGSSVKVSCKASGGTLSRYALSWVRQAPGQGPEWVGAIIPIFGTPHYSKKFQDRVTITV
DTSTNTAFMELSSLRFEDTALYFCARGHDEYDISGYHRLDYWGQGTLVTVSS (SEQ ID NO: 537)

VH QVQLVQSGSELKKPGSSVKVSCKASGYSFSGYYIHWVRQAPGQGLEVWMGWIDPNSGVTNYVRRFQGRVTMTR
DTSLSTAYMELSGLTADDTAVYYCARDENLWQFGYLDYWGQGTLVTVSS (SEQ ID NO: 538)

VH QVQLVQSGAEVKKPGSSVKVSCKASGGTFSRYGVHWVRQAPGQGLEWMGRLIPIVSMTNYAQKFQDRVSITT
DKSTGTAYMELRSLTSEDTALYYCASVGQQLPWVFFAWGQGTLVTVSS (SEQ ID NO: 539)

VH QVQLVESGGGVVQPGRSLRLSCAASGFTFS<u>SYAMH</u>WVRQAPGKGLEWVAVISFDGSNKYYADSVRGRFTISR
DNSKNTLYLQMNSLRTEDTAVYYCARGWLDRDIDYWGQGTLVTVSS (SEQ ID NO: 540)

VH EVQLVESGGGVVQPGRSLRLSCAASGFTFS<u>SYAMH</u>WVRQAPGKGLEWVAVISFDGSNKYYADSVRGRFTISR
DNSKNTLYLQMNSLRTEDTAVYYCARGWLDRDIDYWGQGTLVTVSS (SEQ ID NO: 541)

VH EVQLVQSGGGLVQPGGSLRLSCAASGFTFS<u>DYGMH</u>WVRQPPGKGLEWLAVISYDGSYKIHADSVQGRFTISR
DNAKNSVFLQMNSLKTEDTAVYYCTTDRKWLAWHGMDVWGQGTTVTVSS (SEQ ID NO: 542)

VH EVQLVQSGAEVKKPGSSVKVSCKASGGTFS<u>SYAIS</u>WVRQAPGQGLEWMGGIIPIFGTANYAQKFQGRVTITA
DESTSTAYMELSSLRSEDTAVYYCARDGIVADFQHWGQGTLVTVSS (SEQ ID NO: 543)

VH EVQLVESGAEVKKPGASVKVSCKASGDTFSRYGITWVRQAPGRGLEWMGNIVPFFGATNYAQKFQGRLTITA
DKSSYTSYMDLSSLRSDDTAVYYCARDHFYGSGGYFDYWGQGTLVTVSS (SEQ ID NO: 544)

VH EVQLLESGAEVKKPGASVKVSCKASGYTFNSYDINWVRQAPGQGLEWMGGIIPVFGTANYAESFQGRVTMTA
DHSTSTAYMELNNLRSEDTAVYYCARDRWHYESRPMDVWGQGTTVTVSS (SEQ ID NO: 545)

VH EVQLVESGGGLVRPGGSLRLACAASGFSFSDYYMTWIRQAPGRGLEWIAYISDSGQTVHYADSVKGRFTISR
DNTKNSLFLQVNTLRAEDTAVYYCAREDLLGYYLQSWGQGTLVTVSS (SEQ ID NO: 546)

VH QVQLQQSGPGLVKPSQTLSLTCAISGDSVSSNSAAWNWIRQSPSRGLEWLGRTYYRSKWYNDYAVSVKSRIT
INPDTSKNQFSLQLNSVTPEDTAVYYCARDEPRAVAGSQAYYYYGMDWGQGTTVTVSS (SEQ ID
NO: 547)

VH EVQLVQSGAEVKKPGASVKVSCKASGYTFTSYYMHWVRQAPGQGLEWMGIINPSDGSTSYAQKFQGRVTMTR
DTSTSTVHMELSSLRSEDTAVYYCARDLFPHIYGNYYGMDIWGQGTTVTVSS (SEQ ID NO: 548)

VH QMQLVQSGGGVVQPGRSLRLSCAASGFTFSSYAMHWVRQAPGKGLEWVAVISFDGSNKYYADSVRGRFTISR
DNSKNTLYLQMNSLRTEDTAVYYCARGWLDRDIDYWGQGTLVTVSS (SEQ ID NO: 549)

VH QVQLVESGGGVVQPGRSLRLSCAASGFTFS<u>SYAMH</u>WVRQAPGKGLEWVAVISFDGSNKYYADSVRGRFTISR
DNSKNTLYLQMNSLRTEDTAVYYCARGWLDRDIDYWGQGTLVTVSS (SEQ ID NO: 550)

VL QSVLTQPPSVSAAPGQKVTISCSGNNSNIANNYVSWYQQLPGTAPKLLIYDNNYRPSGIPDRFSGSKSGTSA
TLDITGLQTGDEADYYCGVWDGSLTTGVFGGGTKLTVL (SEQ ID NO: 551)

VL AIQMTQSPSSLSASVGDRVTITCRASQGISNYLAWYQQKPGKVPKLLIYAASTLESGVPSRFSGSGSGTDFT
LTISSLQPEDLATYYCQQLHTFPLTFGGGTKVEIK (SEQ ID NO: 552)

VL QPVLTQPPSASGSPGQSVTISCTGTSSDVGAYNFVSWYRQHPGKAPKLMIYEVNKRPSGVPDRFSGSKSGNT
ASLTVSGLQAEDEADYYCSSYAGTNSLGIFGTGTKLTVL (SEQ ID NO: 553)

TABLE 15-continued

Variable Heavy Chain Region (VH) and Variable Light Chain Region (VL) Sequences for Activatable Antibodies that Bind PDL1 (CDR sequences are underlined; CDR sequences disclosed herein were identified in accordance with the definitions of Kabat, Sequences of Proteins of Immunological Interest (National Institutes of Health, Bethesda, Md. (1987 and 1991)))

VL QSVVTQPPSVSAAPGQKVTISCSGSSSDIGNHYVSWYQQLPGTAPKLLIYDNNQRPSGIPDRFSGSKSGTSA
TLAITGLQTGDEADYYCGTWDNSLSPHLLFGGGTKLTVL (SEQ ID NO: 554)

VL QSVLTQPPSVSAAPGQKVTISCSGSSSNMGNNYVSWYKQVPGTAPKLLIYENDKRPSGIPDRFSGSKSGTSA
TLGITGLQTGDEADYYCGTWDNSLSGFVFASGTKVTVL (SEQ ID NO: 555)

VL QSALTQPASVSGSLGQSVTISCTGSSSDVGSYNLVSWYQQHPGKAPNLMIYDVSKRSGVSNRFSGSKSGNTA
SLTISGLQAEDEADYYCSSYTGISTVVFGGGTKLTVL (SEQ ID NO: 556)

VL QSVLTQPASVSGSPGQSITISCTGTSSDVGSYNLVSWYQQHPGKAPKLMIYEVSKRPSGVSNRFSGSKSGNT
ASLTISGLQAEDEADYYCSSYGGFNNLLFGGGTKLTVL (SEQ ID NO: 557)

VL DIVMTQSPSSLSASIGDRVTITCRASQRISAYVNWYQQKPGKAPKVLIYAASSLRSGVPSRFSGSGSGTDFT
LTISSLQPEDFATYYCQQTYSSPWTFGQGTKVEIK (SEQ ID NO: 558)

VL QSVLTQPPSASGSPGQSVTISCTGTSSDIGGYDSVSWYQQHPGKAPKLMIYDVSKRPSGVSNRFSGSKSGNT
ASLTISGLQAEDEADYYCSSYTSSSIFFYVFGTGTKVTVL (SEQ ID NO: 559)

VL LPVLTQPASVSGSPGQSITISCTGTTSDIGGYDYVSWYQQHPGKAPKLMIYDVSKRPSGVSNRFSGSKSGNT
ASLTISGLQAEDEADYYCSSYTSSSTHVFGTGTKLTVL (SEQ ID NO: 560)

VL QSALTQPASVSGSPGQSITISCTGTSSDVGGYNYVSWYQQHPGKAPKLMIYDVSNRPSGVSNRFSGSKSGNT
ASLTISGLQAEDEADYYCSSYRSSTLGPVFGGGTKLTVL (SEQ ID NO: 561)

VL QAGLTQPPSVSEAPRQRVTISCSGSSSNIGNNAVNWYQQLPGKAPKLLIYYDDLLPSGVSDRFSGSKSGTSA
SLAISGLQSEDEADYYCAAWDDSLNGYVFGTGTKLTVL (SEQ ID NO: 562)

VL QSALTQPRSVSGSPGQSVTISCTGTSSDVGGYNYVSWYQQHPGKAPKLMIYDVSKRPSGVPDRFSGSKSGNT
ASLTISGLQAEDEADYYCSSYTSSTTHVFGTGTKVTVL (SEQ ID NO: 563)

VL QSVVTQPPSVSAAPGQKVTISCSGSSSNIGNNYVSWYQQLPGTAPKLLIYDNNKRPSGIPDRFSGSKSGTSA
TLGITGLQTGDEADYYCGTWDSSLSVWVFGGGTQLTVL (SEQ ID NO: 564)

VL QSVLTQPASVSGSPGQSITISCTGTSSDVGGYNYVSWYQQHPGRAPRLMIYDVSNRPSGVSNRFSGSKSGNT
ASLTISGLQAEDEGDYYCSSYTSGGTLGPVFGGGTKLTVL (SEQ ID NO: 565)

VL QAGLTQPPSASGTPGQRVTISCSGSSSNIGSNTVNWYQQLPGTAPKLLIYSNNQRPSGVPDRFSGSKSGTSA
SLAISGLQSEDEADYYCAAWDDSLNGWFGGGTKLTVL (SEQ ID NO: 566)

VL AIRMTQSPSSLSASVGDRVTITCRASQSISNYLNWYQQRPGKAPNLLIY<u>AASSLQ</u>SGVPSRFSGSGSGTDFT
LTISSLQPEDFATYYCQQTYSTPYTFGQGTKLEIK (SEQ ID NO: 567)

VL QSVLTQPASVSGSPGQSITISCTGTSSDVGGYNYVSWYRQHPGKAPKLMIYDVSYRPSGVSNRFSGSKSGNT
ASLTISGLQAEDEADYYCSSYTDSSTRYVFGTGTKLTVL (SEQ ID NO: 568)

VL QPVLTQPPSASGTPGQRVAISCSGSRSKIEINSVNWYQQLPGTAPKLLIYDKNKRPSGIPDRFSGSKSGTSA
TLGITGLQTGDEADYYCGSWDSSLSADVFGTGTKLTVL (SEQ ID NO: 569)

VL QSVLTQPPSVSAAPGKKVTISCSGSSSNIGNNYVSWYQQLPGTAPKLLIYRNNQRPSGVPDRFSGSKSGTSA
SLAISGLQSEDEADYYCATWDDSLNGWVFGGGTKLTVL (SEQ ID NO: 570)

VL QSVVTQPPSVSGAPGQRVTISCTGSSSNIGAGYDVHWYQQLPGTAPKLLIYGNNNRHSGVPDRFSGSKSGTS
ASLAITGLQAEDEAEFFCGTWDSRLTTYVFGSGTKLTVL (SEQ ID NO: 571)

VL QSVVTQPPSVSAAPGQKVTISCSGSSSNIGNNYVSWYQQLPGTAPKLLIYDNNKRPSGIPDRFSGSKSGTSA
TLGITGLQTGDEADYYCGTWDSSLSAVVFGGGTKLTVL (SEQ ID NO: 572)

VL VIWMTQSPSSLSASVGDRVTITCAASSLQSWYQQKPGKAPKLLIYEASTLESGVPSRFSGSGSGTEFTLTIS
SLQPEDFATYYCQQSYSTPYTFGQGTKLEIK (SEQ ID NO: 573)

VL QSVVTQPPSVSAAPGQKVTISCSGSSSNIGNNYVSWYQQVPGTAPKLLIYDNNKRPSGIPDRFSGSNSDTSA
TLGITGLQTGDEADYYCGTWDSSLSAWVFGGGTKLTVL (SEQ ID NO: 574)

VL QSVVTQPPSVSAAPGQKVTISCSGSSSNIGNNYVSWYQQLPGTAPKLLIYDNNKRPSGIPDRFSGSKSGTSA
TLGITGLQTGDEADYYCGTWDSSLSAGSWFGGGTKLTVL (SEQ ID NO: 575)

VL SYELMQPPSVSVAPGKTATIACGGENIGRKTVHWYQQKPGQAPVLVIYYDSDRPSGIPERFSGSNSGNTATL
TISRVEAGDEADYYCLWDSSSDHRIFGGGTKLTVL (SEQ ID NO: 576)

VL SYELMQPPSVSVAPGKTATIACGGENIGRKTVHWYQQKPGQAPVLVIYYDSDRPSGIPERFSGSNSGNTATL
TISRVEAGDEADYYCQWDSSSDHRIFGGGTKLTVL (SEQ ID NO: 577)

TABLE 15-continued

Variable Heavy Chain Region (VH) and Variable Light Chain Region (VL)
Sequences for Activatable Antibodies that Bind PDL1 (CDR sequences are
underlined; CDR sequences disclosed herein were identified in accordance with
the definitions of Kabat, Sequences of Proteins of Immunological Interest
(National Institutes of Health, Bethesda, Md. (1987 and 1991)))

VL SYELMQPPSVSVAPGKTATIACGGENIGRKTVHWYQQKPGQAPVLVIYYDSDRPSGIPERFSGSNSGNTATL
TISRVEAGDEADYYCQVWDSSSDHRIFGGGTKLTVL (SEQ ID NO: 578)

VL SYELMQPPSVSVAPGKTATIACGGENIGRKTVHWYQQKPGQAPVLVIYYDSDRPSGIPERFSGSNSGNTATL
TISRVEAGDEADYYCQVWDSSSDHRIFGGGTKLTVL (SEQ ID NO: 579)

Group J*

HC QVQLVQSGVEVKKPGASVKVSCKASGYTFTNYYMYWVRQAPGQGLEWMGGINPSNGGTNFNEKFKNRVTLTT
DSSTTTAYMELKSLQFDDTAVYYCARRDYRFDMGFDYWGQGTTVTVSSASTKGPSVFPLAPCSRSTSESTAA
LGCLVKDYFPEPVTVSWNSGALTSGVHTFPAVLQSSGLYSLSSVVTVPSSSLGTKTYTCNVDHKPSNTKVDK
RVESKYGPPCPPCPAPEFLGGPSVFLFPPKPKDTLMISRTPEVTCVVVDVSQEDPEVQFNWYVDGVEVHNAK
TKPREEQFNSTYRVVSVLTVLHQDWLNGKEYKCKVSNKGLPSSIEKTISKAKGQPREPQVYTLPPSQEEMTK
NQVSLTCLVKGFYPSDIAVEWESNGQPENNYKTTPPVLDSDGSFFLYSRLTVDKSRWQEGNVFSCSVMHEAL
HNHYTQKSLSLSLGK (SEQ ID NO: 580)

HC QVQLVESGGGVVQPGRSLRLDCKASGITFSNSGMHWWVRQAPGKGLEWVAVIWYDGSKRYYADSVKGRFTISR
DNSKNTLFLQMNSLRAEDTAVYYCATNDDYWGQGTLVTVSSASTKGPSVFPLAPCSRSTSESTAALGCLVKD
YFPEPVTVSWNSGALTSGVHTFPAVLQSSGLYSLSSVVTVPSSSLGTKTYTCNVDKKPSNTKVDKRVESKYG
PPCPPCPAPEFLGGPSVFLFPPKPKDTLMISRTPEVTCVVVDVSQEDPEVQFNWYVDGVEVHNAKTKPREEQ
FNSTYRVVSVLTVLHQDWLNGKEYKCKVSNKGLPSSIEKTISKAKGQPREPQVYTLPPSQEEMTKNQVSLTC
LVKGFYPSDIAVEWESNGQPENNYKTTPPVLDSDGSFFLYSRLTVDKSRWQEGNVFSCSVMHEALHNHYTQK
SLSLSLGK (SEQ ID NO: 581)

LC EIVLTQSPATLSLSPGERATLSCRASKGVSTSGYSYLHWYQQKPGQAPRLLIYLASYLESGVPARFSGSGSG
TDFTLTISSLEPEDFAVYYCQHSRDLPLTFGGGTKYEIKRTVAAPSVFIFPPSDEQLKSGTASVVCLLNNFY
PREAKVQWKVDNALQSGNSQESVTEQDSKDSTYSLSSTLTLSKADYEKHKVYACEVTHQGLSSPVTKSFNRG
EC (SEQ ID NO: 582)

LC EIVLTQSPATLSLSPGERATLSCRASQSVSSYLAWYQQKPGQAPRLLIYDASNRATGIPARFSGSGSGTDFT
LTISSLEPEDFAVYYCQQSSNWPRTFGQGTKVEIKRTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC
(SEQ ID NO: 583)

Group K

VH EVQLVESGGGLVQPGGSLRLSCAASGFTFSDSWIHWVRQAPGKGLEWVAWISPYGGSTYYADSVKGRFTISA
DTSKNTAYLQMNSLRAEDTAVYYCARRHWPGGFDYWGQGTLVTVSSASTK (SEQ ID NO: 735)

VH EVQLVESGGGLVQPGGSLRLSCAASGFTFSDSWIHWVRQAPGKGLEWVAWISPYGGSTYYADSVKGRFTISA
DTSKNTAYLQMNSLRAEDTAVYYCARRHWPGGFDYWGQGTLVTVSS (SEQ ID NO: 736)

HC EVQLVESGGGLVQPGGSLRLSCAASGFTFSDSWIHWVRQAPGKGLEWVAWISPYGGSTYYADSVKGRFTISA
DTSKNTAYLQMNSLRAEDTAVYYCARRHWPGGFDYWGQGTLVTVSSASTKGPSVFPLAPSSKSTSGGTAALG
CLVKDYFPEPVTVSWNSGALTSGVHTFPAVLQSSGLYSLSSVVTVPSSSLGTQTYICNVNHKPSNTKVDKKV
EPKSCDKTHTCPPCPAPELLGGPSVFLFPPKPKDTLMISRTPEVTCVVVDVSHEDPEVKFNWYVDGVEVHNA
KTKPREEQYASTYRVVSVLTVLHQDWLNGKEYKCKVSNKALPAPIEKTISKAKGQPREPQVYTLPPSREEMT
KNQVSLTCLVKGFYPSDIAVEWESNGQPENNYKTTPPVLDSDGSFFLYSKLTVDKSRWQQGNVFSCSVMHEA
LHNHYTQKSLSLSPG (SEQ ID NO: 737)

VL DIQMTQSPSSLSASVGDRVTITCRASQDVSTAVAWYQQKPGKAPKLLIYSASFLYSGVPSRFSGSGSGTDFT
LTISSLQPEDFATYYCQQYLYHPATFGQGTKVEIKR (SEQ ID NO: 268)

LC DIQMTQSPSSLSASVGDRVTITCRASQDVSTAVAWYQQKPGKAPKLLIYSASFLYSGVPSRFSGSGSGTDFT
LTISSLQPEDFATYYCQQYLYHPATFGQGTKVEIKRTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC
(SEQ ID NO: 738)

Group L

VH EVQLVESGGGLVQPGGSLRLSCAASGFTFSRFWMSWVRQAPGKGLEWVANINQDGTEKYYVDSVKGRFTISR
DNAKNSLYLQMNSLRAGDTAVYYCANTYYDFWSGHFDYWGQGTLVTVSS (SEQ ID NO: 739)

VH QEHLVESGGGVVQPGRSLRLSCEASGFTFSNFGMHWVRQAPGKGLEWVAALWSDGSNKYYADSVKGRVTISR
DNSKNTLYLQMNSLRAEDTAVYYCARGRGAPGIPIFGYWGQGTLVTVSS (SEQ ID NO: 740)

VH EVQLVESGGGLVKPGGSLRLSCAASGFTFSNAWMSWVRQAPGKGLEWVGRIKRKTDGGTTDYAAPVKGRFTI
SRDDSKNTLHLQMNSLKTEDTAVYYCTTDDIVVVPAVMREYYFGMDVWGQGTTVTVSS (SEQ ID
NO: 741)

VH QVQLVQSGAEVKKPGASVQVSCKASGYSFTGYYIHWVRQAPGQGLEWMGWINPNSGTKKYAHKFQGRVTMTR
DTSIDTAYMILSSLISDDTAVYYCARDEDWNFGSWFDSWGQGTLVTVSS (SEQ ID NO: 742)

TABLE 15-continued

Variable Heavy Chain Region (VH) and Variable Light Chain Region (VL)
Sequences for Activatable Antibodies that Bind PDL1 (CDR sequences are
underlined; CDR sequences disclosed herein were identified in accordance with
the definitions of Kabat, Sequences of Proteins of Immunological Interest
(National Institutes of Health, Bethesda, Md. (1987 and 1991)))

VH QVHLVQSGAEVKKPGASVKVSCKAS<u>GYTFTGYYI</u>HWVRQAPGHGLEWMGW<u>LNPNTGTT</u>KYIQNFQGRVTMTR
DTSSSTAYMELTRLRSDDTAVYYC<u>ARDEDWNYGSWFDT</u>WGQGTLVTVSS (SEQ ID NO: 743)

VH EVQLVESGGGVVRPGGSLRLSCAAS<u>GFTFDDYGMT</u>WVRQAPGRGLEWVSG<u>IHWHGKRT</u>GYADSVKGRFTISR
DNAKKSLYLQMNSLKGEDTALYHC<u>VRGGMSTGDWFDP</u>WGQGTLVIVSS (SEQ ID NO: 744)

VH EVQLVESGGGVVRPGGSLRLSCAAS<u>GFTFDDYGMT</u>WVRQVPGKGLEWVSG<u>IHWSGRST</u>GYADSVKGRFTISR
DNAKNSLYLQMNSLRAEDTALYYC<u>ARGGMSTGDWFDP</u>WGQGTLVTVSS (SEQ ID NO: 745)

VH EVQLVESGGGLVQPGGSLRLSCAAS<u>GFTVGSNYM</u>NWVRQAPGKGLEWVSV<u>IYSGGST</u>YYADSVKGRFTISRL
TSKNTLYLQMSSLRPEDTAVYYC<u>ARGIRGLDV</u>WGQGTTVTVSS (SEQ ID NO: 746)

VH EERLVESGGDLVQPGGSLRLSCAAS<u>GITVGTNYM</u>NWVKQAPGKGLEWVSV<u>ISSGGNT</u>HYADSVKGRFIMSRQ
TSKNTLYLQMNSLETEDTAVYYC<u>ARGIRGLDV</u>WGQGTMVTVSS (SEQ ID NO: 747)

VH QVQLVQSGAEVKMPGSSVRVSCKAS<u>GGIFSSSTI</u>SWVRQAPGQGLEWMGE<u>IIPVFGTV</u>NYAQKFQDRVIFTA
DESTTTAYMELSSLKSGDTAVYFC<u>ARNWGLGSFYI</u>WGQGTMVTVSS (SEQ ID NO: 748)

VH EVQLVESGGDLVHPGRSLRLSCAAS<u>GFPFDEYAM</u>HWVRQVPGKGLEWVSG<u>ISWSNNNI</u>GYADSVKGRFTISR
DNAKNSLYLQMNSLRPEDTAFYYC<u>AKSGIFDS</u>WGQGLVTVSS (SEQ ID NO: 749)

VH EVQLVESGGGVVQPGRSLRLSCAAS<u>GFTFSSYGM</u>HWVRQAPGKGLEWVTL<u>ISYEGRNK</u>YYADSVKGRFTISR
DNSKNTLYLQMNSLRAEDTAVYYC<u>AKDRTLYGMDV</u>WGQGTTVTVSS (SEQ ID NO: 750)

VH QVTLRESGPALVKTTQTLTLTCTFS<u>GFSLSTNRMC</u>VTWIRQPPGKALEWLAR<u>IDWDGVK</u>YYNTSLKTRLTIS
KDTSKNQVVLTMTNMDPVDTATFYC<u>ARSTSLTFYYFDY</u>WGQGTLVTVSS (SEQ ID NO: 751)

VH EVQLVESGGGLVQPGGSLRLSCAAS<u>EFTVGTNHM</u>NWVRQAPGKGLEWVSV<u>IYSGGNT</u>FYADSVKGRFTISRH
TSKNTLYLQMNSLTAEDTAVYYC<u>ARGLGGMDV</u>WGQGTTVTVSS (SEQ ID NO: 752)

VH EVQLVESGGGLVQRGESLRLYCAAS<u>GFTFSKYWM</u>NWVRQAPGKGLEWVAN<u>IKGDGSEK</u>YYVDSVKGRFTISR
DNAKNSLYLQMNSLRAEDTAVYYC<u>ARDYWGSGYYFDF</u>WGQGTLVTVSS (SEQ ID NO: 753)

VH EVQLVESGGGLVQSGGSLRLSCAAS<u>GFTFSSYWM</u>SWVRQAPGKGLEWVAN<u>IKQDGSEK</u>YYVDSVKGRFTISR
DNAKNSLYLQMNSLRADDTAVYYC<u>ARDDIVVVPAPMGYYYYYFGMDV</u>WGQGTTVTVSS (SEQ ID
NO: 754)

VH EVQLVESGGGLVQPGRSLRLSCAAS<u>GFTFDDFAM</u>HWVRQAPGKGLEWVSG<u>ISWTGGNMDY</u>ANSVKGRFTISR
EDAKNSLYLQMNSLRAADTALYYC<u>VKDIRGIVATGGAFDI</u>WGRGTMVTVSS (SEQ ID NO: 755)

VH EVQLVESGGGLVQPGGSLRLSCAAS<u>GFTVGTNYM</u>NWVRQAPGKGLEWISV<u>IYSGGST</u>FYADSVKGRFTISRQ
TSQNTLYLQMNSLRPEDTAVYYC<u>ARGIRGFDI</u>WGQGTMVTVSS (SEQ ID NO: 756)

VH EVQLVESGGGLVQPGGSLRLSCAAS<u>GFTISTNYM</u>NWVKQAPGKGLEWVAV<u>IYSSGST</u>YYIDSVKGRFTISRL
TSKNTVYLQMSSLNSEDTAVYYC<u>ARGIRGFDI</u>WGQGTMVTVSS (SEQ ID NO: 757)

VH EVQLVESGGGLVQPGRSLRLSCAAS<u>GFTIDDSAM</u>HWVRQTPGKGLEWVSG<u>ISWKSGSI</u>GYADSVRGRFTISR
DNAKNSLYLQMNSLRVEDTALYYC<u>VKDIRGNWNYGGNWFDP</u>WGQGTLVTVSS (SEQ ID NO: 758)

VH EVQLVESGGGLVQPGGSLRLSCEAS<u>GFTVGVNHM</u>NWVRQAPGKGLEWVSV<u>IFSSGRT</u>FYGDYVKGRLTIFRQ
TSQNTVYLQMNSLRSEDTAIYYC<u>ARGIGGLDI</u>WGRGTMVTVSS (SEQ ID NO: 759)

VH EVQLVESGGGLVQPGRSLRLSCAAS<u>GFTFDDYAL</u>HWVRQAPGKGLEWVSG<u>ISWTGGTI</u>DYADSVKGRFTISR
DNAKNSLYLQMSSLRTEDTAIYYC<u>TRDIRGNWKYGGWFDP</u>WGQGTLVTVSS (SEQ ID NO: 760)

VH QVQLVQSGTEVKKPGASVKVSCKAS<u>GYTFTAYYM</u>HWVRQAPGQGLDWMGW<u>ISPNSGFT</u>NYAQKFQGRVTMTR
DTSINTFYMELSGLRSDDTAVYYC<u>AREGSTHHNSFDP</u>WGQGTLVTVSS (SEQ ID NO: 761)

VH EVQLVESGGGLVQPGGSLRLSCAAS<u>GFTVGTNFM</u>NWVRQAPGKGLEWVSAIYSGGTANYADSVKGRFTISRD
TSRNTLYLQMNSLRTEDTAVYYC<u>ARGGGMDV</u>WGQGTTVTVSS (SEQ ID NO: 762)

VH QVQLVQSGAEVKKPGSSVKVSCKAS<u>GGTFNTYVL</u>SWVRQAPGQGLEWMGE<u>IIPILGAA</u>NYAQNFQGRVTFTT
DESTNTAYMDLSSLRSEDTAVYYC<u>ARDRTSGGFDP</u>WGQGTLVTVSS (SEQ ID NO: 763)

VH QVQLVQSGAEVEKPGASVKVSCKAS<u>GYIFTHYGI</u>SWVRQAPGQGLEWVGW<u>ISPYNGYT</u>DYAQKLQGRVTLTT
DTSTTTAYMELRNLRSDDTAMYYC<u>SRGRGPYWSFDL</u>WGRGTLVTVSS (SEQ ID NO: 764)

VL DIQMTQSPSTLSASVGDRVTITCRAS<u>QSISNW</u>LAWYQQKPGKAPKLLIYKASSLESGVPSRFSGSGSGTEFT
LTISSLQPDDFATYYC<u>QQYHSYSYT</u>FGQGTKEIK (SEQ ID NO: 765)

VL DIQMTQSPSSLSASVGDRVTITCRAS<u>QGIRND</u>LGWYQQKPGKAPKRLIYTASSLQSGVPSRFSGSGSGTEFT
LTISSLQPEDFATYYC<u>LQHNSYPLT</u>FGGGTKVAIK (SEQ ID NO: 766)

TABLE 15-continued

Variable Heavy Chain Region (VH) and Variable Light Chain Region (VL) Sequences for Activatable Antibodies that Bind PDL1 (CDR sequences are underlined; CDR sequences disclosed herein were identified in accordance with the definitions of Kabat, Sequences of Proteins of Immunological Interest (National Institutes of Health, Bethesda, Md. (1987 and 1991)))

```
VL  DIQMTQSPSSLSASVGDRVTITCRTSQGIRNDLGWYQQKPGKAPKRLIYAASSLQSGVPSRFSGSGSGTEFT
    LTISSLQPEDFATYYCLQHNNYPYTFGQGTKLEIK (SEQ ID NO: 767)

VL  DIVMTQTPLSSPVTLGQPASISCRSSQTLVHGDGNTYLSWIQQRPGQPPRLLIYKVSNQFSGVPDRFSGSGA
    GTDFTLKISRVEAEDVGLYFCMQATHFPITFGQGTRLEIK (SEQ ID NO: 768)

VL  DIVMTQTPLSSPVTLGQPASISCRSSPSLVHSDGNTYLSWLQQRPGQPPRLLIYKISNRFSGVPDRFSGSGA
    GTDFTLKISRVEAEDVGVYYCMQATHFPITFGQGTRLEIR (SEQ ID NO: 769)

VL  DIQMTQSPSSLSASLGDRVTITCRASQSINSYLNWYQQKPGKAPKLLIYVASSLQSGVPSRFSGSGSGTEFT
    LTISNLQPEDFATYYCQQSYSTPPITFGQGTRLEIK (SEQ ID NO: 770)

VL  DIQMTQSPSSLSASVGDRVTITCRASQSISSYLNWYQQKPGKAPKLLIYVASSLQSGVPSRFSGSGSGTDFT
    LTISSLQPEDFATYYCQQSYSTPPITFGQGTRLEIK (SEQ ID NO: 771)

VL  DIQMTQSPSSLSASVGDRVTITCRASQTINIYLNWYQQKPGRAPRLLIYAASSLQSGVPSRFSGSGSGTDFT
    LTISSLQPEDFATYYCHQSYSTPPITFGQGTRLEIK (SEQ ID NO: 772)

VL  DIQMTQSPSSLSASVGDRVTITCRASQSMSSYLNWYQQKPGRAPKLLIFAASSLQSGVPSRFSGSGSGTDFT
    LTISSLQPEDFATYYCQQSYSTPPITFGQGTRLEIK (SEQ ID NO: 773)

VL  EIVLTQSPGTLSLSPGERATLSCRASQSFNFNYLAWYQQKPGQAPRLLIYGASSRATGIPDRFSGSGSGTDF
    TLTINRLEPEDFGVFYCQQYESAPWTFGQGTKVEIK (SEQ ID NO: 774)

VL  DIQMTQSPSSLSASVGDRVTITCRASQSISSYLNWYQQKPGKLLIYAASSLQSGVPSRFSGGGSGTDFTLTI
    SSLRPEDFATYYCQQSYCTPPITFGQGTRLEIK (SEQ ID NO: 775)

VL  DIQMTQSPSSLSASVGDRVTITCRASQSISSYLNWYQQKPGKAPKLLIYAASSLQSGVPSRFSGSGSGTDFT
    LTISSLQPEDFATYYCQQSYSTPPITFGQGTRLEIK (SEQ ID NO: 776)

VL  DRVTITCRASQVISNYLAWYQQKPGKVPRLLIYAASTLQSGVPSRFSGSGSGTDFTLTISSLQPEDVATYYC
    QKYNSAPRTFGQGTKVEIK (SEQ ID NO: 777)

VL  DIQMTQSPSSLSASVGDRVTITCRASQNINNYLNWYQQKPGKAPKLLIYAASSFQNAVPSRFSGSGSGTDFT
    LTISSLQPEDFATYYCQQSYNTPLTFGGGTKVEIK (SEQ ID NO: 778)

VL  DIQMTQSPSSLSASVGDRVTITCRASQGIRNDLGWYQQKPGKAPKRLIYAASSLQSGVPSRFSGSGSGTEFT
    LTISSLQPEDFATYYCLQHNSYPYTFGQGTKLEIK (SEQ ID NO: 779)

VL  DIQMTQSPSSLSASVGDRVTITCRASQSISSYLNWYQQKPGKAPKLLIYAASSLQSGVPSRFSGSGSGTDFT
    LTISSLQPEDFATYYCQQSYSTPPITFGQGTRLEIK (SEQ ID NO: 780)
```

Group M

```
VH  QSLEESGGRLVKPDETLTITCTVSGIDLSSNGLTWVRQAPGEGLSWIGTINKDASAYYASWAKGRLTISKPS
    STKVDLKITSPTTEDTATYFCGRIAFKTGTSIWGPGTLVTVSS (SEQ ID NO: 1108)

VL  AIVMTQTPSPVSAAVGGTVTINCQASESVYSNNYLSWFQQKPGQPPKLLIYLASTLASGVPSRFKGSGSGTQ
    FTLTISGVQCDDAATYYCIGGKSSSTDGNAFGGGTEVVVR (SEQ ID NO: 1109)
```

Group N

```
VH  QMQLVQSGAEVKKPGSSVKVSCKASGGTFSSYAISWVRQAPGQGLEWMGGIIPIFGTANYAQKFQGRVTITA
    DESTSTAYMELSSLRSEDTAVYYCARGNIVATITPLDYWGQGTLVTVSS (SEQ ID NO: 1110)

VH  QPVLTQPPSVSAAPGQKVTISCSGSSSNIANNYVSWYQQLPGTAPKLLIFANNKRPSGIPDRFSGSKSGTSA
    ALDITGLQTGDEADYYCGTWDSDLRAGVFGGGTKLTVL (SEQ ID NO: 1111)

VH  EVQLVQSGAEVKKPGSSVKVSCKASGGTFSSYAISWVRQAPGQGLEWMGGIIPIFGTANYAQKFQGRVTITA
    DKSTSTAYMELSSLRSEDTAVYYCAREGTIYDSSGYSFDYWGQGTLVTVSS (SEQ ID NO: 1112)

VH  QVQLVESGGGVVQPGRSLRLSCAASGFTFSSYAMHWVRQAPGKGLEWVAVISFDGSNKYYADSVRGRFTISR
    DNSKNTLYLQMNSLRTEDTAVYYCARGWLDRDIDYWGQGTLVTVSS (SEQ ID NO: 1113)

VH  EVQLVESGGGVVQPGRSLRLSCAASGFTFSSYAMHWVRQAPGKGLEWVAVISFDGSNKYYADSVRGRFTISR
    DNSKNTLYLQMNSLRTEDTAVYYCARGWLDRDIDYWGQGTLVTVSS (SEQ ID NO: 1114)

VH  QVQLVESGGGVVQPGRSLRLSCAASGFTFSSYAMHWVRQAPGKGLEWVAVISFDGSNKYYADSVRGRFTISR
    DNSKNTLYLQMNSLRTEDTAVYYCARGWLDRDIDYWGQGTLVTVSS (SEQ ID NO: 1115)

VH  EVQLVESGGGVVQPGRSLRLSCAASGFTFSSYAMHWVRQAPGKGLEWVAVISFDGSNKYYADSVRGRFTISR
    DNSKNTLYLQMNSLRTEDTAVYYCARGWLDRDIDYWGQGTLVTVSS (SEQ ID NO: 1116)
```

TABLE 15-continued

Variable Heavy Chain Region (VH) and Variable Light Chain Region (VL)
Sequences for Activatable Antibodies that Bind PDL1 (CDR sequences are
underlined; CDR sequences disclosed herein were identified in accordance with
the definitions of Kabat, Sequences of Proteins of Immunological Interest
(National Institutes of Health, Bethesda, Md. (1987 and 1991)))

VH EVQLVESGGGVVQPGRSLRLSCAASGFTFSSYAMHWVRQAPGKGLEWVAVISFDGSNKYYADSVRGRFTISR
DNSKNTLYLQMNSLRTEDTAVYYCARGWLDRDIDYWGQGTLVTVSS (SEQ ID NO: 1117)

VH QVQLVESGGGVVQPGRSLRLSCAASGFTFSSYAMHWVRQAPGKGLEWVAVISFDGSNKYYADSVRGRFTISR
DNSKNTLYLQMNSLRTEDTAVYYCARGWLDRDIDYWGQGTLVTVSS (SEQ ID NO: 1118)

VH QVQLVQSGAEVKKPGSSVKVSCKASGGTFSRYGVHWVRQAPGQGLEWMGRLIPIVSMTNYAQKFQDRVSITT
DKSTGTAYMELRSLTSEDTALYYCASVGQQLPWVFFAWGQGTLVTVSS (SEQ ID NO: 1119)

VH QMQLVQSGGGVVQPGRSLRLSCAASGFTFSSYAMHWVRQAPGKGLEWVAVISFDGSNKYYADSVRGRFTISR
DNSKNTLYLQMNSLRTEDTAVYYCARGWLDRDIDYWGQGTLVTVSS (SEQ ID NO: 1120)

VH QVQLVQSGGGVVQPGRSLRLSCAASGFTFSSYAMHWVRQAPGKGLEWVAVISFDGSNKYYADSVRGRFTISR
DNSKNTLYLQMNSLRTEDTAVYYCARGWLDRDIDYWGQGTLVTVSS (SEQ ID NO: 1121)

VH QMQLVQSGAEVKKPGSSVKVSCKASGGTFSSYAYSWVRQAPGQGLEWMGGIIPSFGTANYAQKFQGRVTITA
DESTSTAYMELSSLRSEDTAVYYCARGPIVATITPLDYWGQGTLVTVSS (SEQ ID NO: 1122)

VH QMQLVQSGAEVKKPGSSVKVSCKASGGTFSSYAYSWVRQAPGQGLEWMGGIIPIFGTANYAQKFQGRVTITA
DESTSTAYMELSSLRSEDTAVYYCARGPIVATITPLDYWGQGTLVTVSS (SEQ ID NO: 1123)

VH QMQLVQSGAEVKKPGSSVKVSCKASGGTFSSYAYSWVRQAPGQGLEWMGGIIPSFGTANYAQKFQGRVTITA
DESTSTAYMELSSLRSEDTAVYYCARGPIVATITPLDYWGQGTLVTVSS (SEQ ID NO: 1124)

VH QMQLVQSGAEVKKPGSSVKVSCKASGGTFSSYAISWVRQAPGQGLEWMGGIIPAFGTANYAQKFQGRVTITA
DESTSTAYMELSSLRSEDTAVYYCARGPIVATITPLDYWGQGTLVTVSS (SEQ ID NO: 1125)

VL SYELMQPPSVSVAPGKTATIACGGENIGRKTVHWYQQKPGQAPVLVIYYDSDRPSGIPERFSGSNSGNTATL
TISRVEAGDEADYYCQVWDSSSDHRIFGGGTKLTVL (SEQ ID NO: 1126)

VL AIRMTQSPSSLSASVGDRVTITCRASQSISSYLNWYQQKPGKAPKLLIYTTSSLKSGVPSRFSGSGSGTDFT
LTISRLQPEDFATYYCQQSYSSTWTFGRGTKVEIK (SEQ ID NO: 1127)

VL QSVLTQPPSVSAAPGQKVTISCSGNNSNIANNYVSWYQQLPGTAPKLLIYDNNYRPSGIPDRFSGSKSGTSA
TLDITGLQTGDEADYYCGVWDGSLTTGVFGGGTKLTVL (SEQ ID NO: 1128)

VL LPVLTQPASVSGSPGQSITISCTGTTSDIGGYDYVSWYQQHPGKAPKLMIYDVSKRPSGVSNRFSGSKSGNT
ASLTISGLQAEDEADYYCSSYTSSSTHVFGTGTKLTVL (SEQ ID NO: 1129)

VL QSALTQPASVSGSPGQSITISCTGTSSDVGGYNYVSWYQQHPGKAPKLMIYDVSNRPSGVSNRFSGSKSGNT
ASLTISGLQAEDEADYYCSSYRSSTLGPVFGGGTKLTVL (SEQ ID NO: 1130)

VL QAGLTQPPSVSEAPRQRVTISCSGSSSNIGNNAVNWYQQLPGKAPKLLIYYDDLLPSGVSDRFSGSKSGTSA
SLAISGLQSEDEADYYCAAWDDSLNGYVFGTGTKLTVL (SEQ ID NO: 1131)

VL QSALTQPRSVSGSPGQSVTISCTGTSSDVGGYNYVSWYQQHPGKAPKLMIYDVSKRPSGVPDRFSGSKSGNT
ASLTISGLQAEDEADYYCSSYTSSTTHVFGTGTKVTVL (SEQ ID NO: 1132)

VL QSVVTQPPSVSAAPGQKVTISCSGSSSNIGNNYVSWYQQLPGTAPKLLIYDNNKRPSGIPDRFSGSKSGTSA
TLGITGLQTGDEADYYCGTWDSSLSVWVFGGGTQLTVL (SEQ ID NO: 1133)

VL QSVLTQPASVSGSPGQSITISCTGTSSDVGGYNYVSWYQQHPGRAPRLMIYDVSNRPSGVSNRFSGSKSGNT
ASLTISGLQAEDEGDYYCSSYTSGGTLGPVFGGGTKLTVL (SEQ ID NO: 1134)

VL QSVVTQPPSVSAAPGQKVTISCSGSSSNIGNNYVSWYQQLPGTAPKLLIYDNNKRPSGIPDRFSGSKSGTSA
TLGITGLQTGDEADYYCGTWDSSLSAVVFGGGTKLTVL (SEQ ID NO: 1135)

VL QSVVTQPPSVSAAPGQKVTISCSGSSSNIGNNYVSWYQQVPGTAPKLLIYDNNKRPSGIPDRFSGSNSDTSA
TLGITGLQTGDEADYYCGTWDSSLSAWVFGGGTKLTVL (SEQ ID NO: 1136)

VL QSVVTQPPSVSAAPGQKVTISCSGSSSNIGNNYVSWYQQLPGTAPKLLIYDNNKRPSGIPDRFSGSKSGTSA
TLGITGLQTGDEADYYCGTWDSSLSAGSVVFGGGTKLTVL (SEQ ID NO: 1137)

VL SYELMQPPSVSVAPGKTATIACGGENIGRKTVHWYQQKPGQAPVLVIYYDSDRPSGIPERFSGSNSGNTATL
TISRVEAGDEADYYCLVWDSSSDHRIFGGGTKLTVL (SEQ ID NO: 1138)

VL SYELMQPPSVSVAPGKTATIACGGENIGRKTVHWYQQKPGQAPVLVIYYDSDRPSGIPERFSGSNSGNTATL
TISRVEAGDEADYYCQVWDSSSDHRIFGGGTKLTVL (SEQ ID NO: 1139)

VL SYELMQPPSVSVAPGKTATIACGGENIGRKTVHWYQQKPGQAPVLVIYYDSDRPSGIPERFSGSNSGNTATL
TISRVEAGDEADYYCQVWDSSSDHRIFGGGTKLTVL (SEQ ID NO: 1140)

VL SYELMQPPSVSVAPGKTATIACGGENIGRKTVHWYQQKPGQAPVLVIYYDSDRPSGIPERFSGSNSGNTATL
TISRVEAGDEADYYCQVWDSSSDHRIFGGGTKLTVL (SEQ ID NO: 1141)

TABLE 15-continued

Variable Heavy Chain Region (VH) and Variable Light Chain Region (VL)
Sequences for Activatable Antibodies that Bind PDL1 (CDR sequences are
underlined; CDR sequences disclosed herein were identified in accordance with
the definitions of Kabat, Sequences of Proteins of Immunological Interest
(National Institutes of Health, Bethesda, Md. (1987 and 1991)))

Group O

VH QVQLVQSGSEVKKSGSSVKVSCKTSGGTFSITNYAINWVRQAPGQGLEWMGGILPIFGAAKYAQKFQDRVTI
TADESTNTAYLELSSLTSEDTAMYYCARGKRWLQSDLQYWGQGTLVTVSS (SEQ ID NO: 1142)

VL QPVLTQPASVSGSPGQSITISCTGSSSDVGSYDLVSWYQQSPGKVPKLLIYEGVKRPSGVSNRFSGSKSGNT
ASLTISGLQAEDEADYYCSSYAGTRNFVFGGGTQLTVL (SEQ ID NO: 1143)

Note that the sequences provided for Group J are heavy chain and light chain amino acid sequences; the sequences provided for Group K include variable heavy chain, variable light chain, heavy chain, and light chain amino acid sequences, all other sequences presented in Table 15 are variable heavy chain and variable light chain sequences Note that the sequences provided for Group J are heavy chain and light chain amino acid sequences; the sequences provided for Group K include variable heavy chain, variable light chain, heavy chain, and light chain amino acid sequences; all other sequences presented in Table 15 are variable heavy chain and variable light chain sequences In some embodiments, the activatable anti-PDL1 antibody includes a heavy chain that comprises or is derived from a heavy chain amino acid sequence shown in U.S. Pat. Nos. 7,943,743; 8,779,108; 8,217,149; 8,460,927; 7,794,710; 8,741,295; and 8,981,063; in US Patent Application Publication Nos. 2014356353; 20130323249; 2014341917; 20130309250; 20110280877; and 20090317368 (now issued as U.S. Pat. No. 8,981,063 listed above); and in PCT Publication Nos. WO2014/100483; WO2012/145493; WO2014/100439; WO2014/195852; WO2014/100079; WO2013/173223; and WO2014/55897, the contents of each of which are hereby incorporated by reference in their entirety. In some embodiments, the activatable anti-PDL1 antibody includes a light chain that comprises or is derived from a light chain amino acid sequence shown in U.S. Pat. Nos. 7,943,743; 8,779,108; 8,217,149; 8,460,927; 7,794,710; 8,741,295; and 8,981,063; in US Patent Application Publication Nos. 2014356353; 20130323249; 2014341917; 20130309250; 20110280877; and 20090317368 (now issued as U.S. Pat. No. 8,981,063); and in PCT Publication Nos. WO2014/100483; WO2012/145493; WO2014/100439; WO2014/195852; WO2014/100079; WO2013/173223; and WO2014/55897, the contents of each of which are hereby incorporated by reference in their entirety. In some embodiments, the activatable anti-PDL1 antibody includes a heavy chain and a light chain that comprise or are derived from a heavy chain amino acid sequence and a light chain amino acid sequence shown in U.S. Pat. Nos. 7,943,743; 8,779,108; 8,217,149; 8,460,927; 7,794,710; 8,741,295; and 8,981,063; in US Patent Application Publication Nos. 2014356353; 20130323249; 2014341917; 20130309250; 20110280877; and 20090317368 (now issued as U.S. Pat. No. 8,981,063); and in PCT Publication Nos. WO2014/100483; WO2012/145493; WO2014/100439; WO2014/195852; WO2014/100079; WO2013/173223; and WO2014/55897, the contents of each of which are hereby incorporated by reference in their entirety.

In some embodiments, the activatable antibody includes an anti-PDL1 antibody that includes at least one CDR sequence selected from the CDR sequences (VH CDR1, VH CDR2, VH CDR3, VL CDR1, VL CDR2, VL CDR3) from the CDR sequences recited in U.S. Pat. No. 7,943,743. In some embodiments, the activatable antibody includes an anti-PDL1 antibody that includes at least one CDR, at least two, at least three, at least four, at least five, and/or six CDR sequences selected from the following sequences in U.S. Pat. No. 7,943,743: SEQ ID NO: 21, SEQ ID NO: 31, SEQ ID NO: 41, SEQ ID NO: 51, SEQ ID NO: 61, and SEQ ID NO: 71. In some embodiments, the activatable antibody includes an anti-PDL1 antibody that includes at least one CDR, at least two, at least three, at least four, at least five, and/or six CDR sequences selected from SEQ ID NO: 22, SEQ ID NO: 32, SEQ ID NO: 42, SEQ ID NO: 52, SEQ ID NO: 62, and SEQ ID NO: 72. In some embodiments, the activatable antibody includes an anti-PDL1 antibody that includes at least one CDR, at least two, at least three, at least four, at least five, and/or six CDR sequences selected from SEQ ID NO: 23, SEQ ID NO: 33, SEQ ID NO: 43, SEQ ID NO: 53, SEQ ID NO: 63, and SEQ ID NO: 73.

In some embodiments, the activatable antibody includes an anti-PDL1 antibody that includes at least one CDR, at least two, at least three, at least four, at least five, and/or six CDR sequences selected from the following sequences in U.S. Pat. No. 7,943,743: a VH CDR1 sequence comprising SEQ ID NO: 21, SEQ ID NO: 22, or SEQ ID NO: 23; a VH CDR2 sequence comprising SEQ ID NO: 31, SEQ ID NO: 32, or SEQ ID NO: 33; a VH CDR3 sequence comprising SEQ ID NO: 41, SEQ ID NO: 42, or SEQ ID NO: 43; a VL CDR1 sequence comprising SEQ ID NO: 51, SEQ ID NO: 52, or SEQ ID NO: 53; a VL CDR2 sequence comprising SEQ ID NO: 61, SEQ ID NO: 62, or SEQ ID NO: 63; and a VL CDR3 sequence comprising SEQ ID NO: 71, SEQ ID NO: 72, or SEQ ID NO: 73.

In some embodiments, the activatable antibody includes an anti-PDL1 antibody that binds a polypeptide that comprises or is derived from SEQ ID NO: 1 or SEQ ID NO: 3 of U.S. Pat. No. 8,460,927.

In some embodiments, the activatable antibody includes an anti-PDL1 antibody that binds a human PDL1 polypeptide that comprises or is derived from SEQ ID NO: 1 of U.S. Pat. No. 8,460,927:

(SEQ ID NO: 585)
MRIFAVFIFMTYWHLLNAFTVTVPKDLYVVEYGSNMTIECKFPVEKQLDL

AALIVYWEMEDKNIIQFVHGEEDLKVQHSSYRQRARLLKDQLSLGNAALQ

ITDVKLQDAGVYRCMISYGGADYKRITVKVNAPYNKINQRILVVDPVTSE

HELTCQAEGYPKAEVIWTSSDHQVLSGKTTTTNSKREEKLFNVTSTLRIN

TTTNEIFYCTFRRLDPEENHTAELVIPELPLAHPPNERTHLVILGAILLC

LGVALTFIFRLRKGRMMDVKKCGIQDTNSKKQSDTHLEET

In some embodiments, the activatable antibody includes an anti-PDL1 antibody that binds a murine PDL1 polypeptide that comprises or is derived from SEQ ID NO: 3 of U.S. Pat. No. 8,460,927:

(SEQ ID NO: 586)
MRIFAGIIFTACCHLLRAFTITAPKDLYVVEYGSNVTMECRFPVERELDL

LALVVYWEKEDEQVIQFVAGEEDLKPQHSNFRGRASLPKDQLLKGNAALQ

ITDVKLQDAGVYCCIISYGGADYKRITLKVNAPYRKINQRISVDPATSEH

ELICQAEGYPEAEVIWTNSDHQPVSGKRSVTTSRTEGMLLNVTSSLRVNA

TANDVFYCTFWRSQPGQNHTAELIIPELPATHPPQNRTHWVLLGSILLFL

IVVSTVLLFLRKQVRMLDVEKCGVEDTSSKNRNDTQFEET

In some embodiments, the activatable antibody includes an anti-PDL1 antibody that binds a polypeptide that comprises or is derived from SEQ ID NO: 36 or SEQ ID NO: 38 of PCT Publication No. WO 2014/10079.

In some embodiments, the activatable antibody includes an anti-PDL1 antibody that binds a human PDL1 polypeptide that comprises or is derived from SEQ ID NO: 36 of PCT Publication No. WO 2014/10079.

(SEQ ID NO: 587)
MRIFAVFIFMTYWHLLNAFTVTVPKDLYVVEYGSNMTIECKFPVEKQLDL

AALIVYWEMEDKNIIQFVHGEEDLKVQHSSYRQRARLLKDQLSLGNAALQ

ITDVKLQDAGVYRCMISYGGADYKRITVKVNAPYNKINQRILVVDPVTSE

HELTCQAEGYPKAEVIWTSSDHQVLSGKTTTTNSKREEKLFNVTSTLRIN

TTTNEIFYCTFRRLDPEENHTAELVIPELPLAHPPNERTHLVILGAILLC

LGVALTFIFRLRKGRMMDVKCGIQDTNSKQSDTHLEET

In some embodiments, the activatable antibody includes an anti-PDL1 antibody that binds a human PDL1 extracellular domain polypeptide that comprises or is derived from SEQ ID NO: 38 of PCT Publication No. WO 2014/10079.

(SEQ ID NO: 588)
FTVTVPKDLYVVEYGSNMTIECKFPVEKQLDLAALIVYWEMEDKNIIQFV

HGEEDLKVQHSSYRQRARLLKDQLSLGNAALQITDVKLQDAGVYRCMISY

GGADYKRITVKVNAPYNKINQRILVVDPVTSEHELTCQAEGYPKAEVIWT

SSDHQVLSGKTTTTNSKREEKLFNVTSTLRINTTTNEIFYCTFRRLDPEE

NHTAELVIPELPLAHPPNERT

In some embodiments, the activatable antibody includes an anti-PDL1 antibody that is or is derived from BMS-936559 (MDX-1 105). In some embodiments, the activatable antibody includes an anti-PDL1 antibody that is or is derived from MPDL3280A (RG7446). In some embodiments, the activatable antibody includes an anti-PDL1 antibody that is or is derived from MEDI4736. In some embodiments, the activatable antibody includes an anti-PDL1 antibody that is or is derived from AMP224. In some embodiments, the activatable antibody includes an anti-PDL1 antibody that is or is derived from MSB0010718C.

In some embodiments, the activatable anti-PDL1 antibody comprises or is derived from an antibody that is manufactured, secreted or otherwise produced by a hybridoma, such as, for example, the hybridoma(s) disclosed in U.S. Pat. No. 8,779,108 and deposited at the National Collections of Industrial and Marine Bacteria (NCIMB) under deposit number 41598, as well as the hybridoma(s) disclosed in U.S. Pat. No. 8,741,295 and deposited at the Collection Nationale De Cultures De Microorganismes (CNCM) under deposit number 1-4080, 1-4081, and/or 1-4122.

In some embodiments, the activatable anti-PDL1 antibody includes a CDR sequence shown in Table 16, a combination of VL CDR sequences (VL CDR1, VL CDR2, VL CDR3) selected from the group consisting of those combinations shown in a single row Table 16, a combination of VH CDR sequences (VH CDR1, VH CDR2, VH CDR3) selected from the group consisting of those combinations shown in Table 16, or a combination of VL CDR and VH CDR sequences (VL CDR1, VL CDR2, VL CDR3, VH CDR1, VH CDR2, VH CDR3) selected the group consisting of those combinations shown in Table 16.

TABLE 16

CDR Sequences for Antibodies and Activatable Antibodies that Bind PDL1

| | VL | | | VH | | |
|---|---|---|---|---|---|---|
| AB Name | CDR1 (SEQ ID NO) | CDR2 (SEQ ID NO) | CDR3 (SEQ ID NO) | CDR1 (SEQ ID NO) | CDR2 (SEQ ID NO) | CDR3 (SEQ ID NO) |
| C8 | RASQSISSYLN (209) | KASRLQS (210) | RALKPVT (211) | SYAMS (212) | DITASGQRTTYADS (213) | SKAIFDY (214) |
| C12 | RASQSISSYLN (209) | AASSLQS (215) | SYSTPNT (216) | SYAMS (212) | SINKDGHYTSYADS (217) | NLDEFDY (218) |
| C16 | RASQSISSYLN (209) | SASQLQS (219) | ANSRP3T (220) | SYAMS (212) | SIMATGAGTLYADS (221) | DGAGEDY (222) |
| C20 | RASQSISSYLN (209) | NASSLQS (223) | YPYGPG (224) | SYAMS (212) | TITSSGAATYYADS (225) | NYTGFDY (226) |
| C60 | RASQSISSYLN (209) | YASTLQS (227) | DNGYPST (228) | SYAMS (212) | SIYSTGGATAYADS (229) | SSAGFDY (230) |
| C1 | RASQSISSYLN (209) | YASTLQS (227) | DNGYPST (228) | SYAMS (212) | SSIYSTGGATAYADS (231) | SSAGQSRPGFDY (232) |

TABLE 16-continued

CDR Sequences for Antibodies and
Activatable Antibodies that Bind PDL1

| | VL | | | VH | | |
|---|---|---|---|---|---|---|
| AB Name | CDR1 (SEQ ID NO) | CDR2 (SEQ ID NO) | CDR3 (SEQ ID NO) | CDR1 (SEQ ID NO) | CDR2 (SEQ ID NO) | CDR3 (SEQ ID NO) |
| D1 | RASQSISSYLN (209) | YASTLQS (227) | DNGYPST (228) | SYAMS (212) | SSIYSTGGATAYADS (231) | SSAGQSWPGFDY (233) |
| G7 | RASQSISSYLN (209) | YASTLQS (227) | DNGYPST (228) | SYAMS (212) | SSIYSTGGATAYADS (231) | SSAGQSFPGFDY (234) |
| H9 | RASQSISSYLN (209) | YASTLQS (227) | DNGYPST (228) | SYAMS (212) | SSIYSTGGATAYADS (231) | WSAAFDY (235) |
| B10 | RASQSISSYLN (209) | YASTLQS (227) | DNGYPST (228) | SYAMS (212) | SSIYSTGGATAYADS (231) | WSAGYDY (236) |
| E10 | RASQSISSYLN (209) | YASTLQS (227) | DNGYPST (228) | SYAMS (212) | SSIYSTGGATAYADS (231) | WSKGFDY (237) |
| A05 | RASQSISSYLN (209) | YASTLQS (227) | DNGYPST (228) | SYAMS (212) | SSIWKQGIVTVYDS (238) | SSAGFDY (230) |
| C05 | RASQSISSYLN (209) | YASTLQS (227) | DNGYPST (228) | SYAMS (212) | SSIWRNGIVTVYDS (239) | SSAGFDY (230) |
| C10 | RASQSISSYLN (209) | YASTLQS (227) | DNGYPST (228) | SYAMS (212) | SDIWKQGMVTVYDS (240) | SSAGFDY (230) |
| D08 | RASQSISSYLN (209) | YASTLQS (227) | DNGYPST (228) | SYAMS (212) | SSIWRQGLATAYDS (241) | SSAGFDY (230) |
| G09 | RASQSISSYLN (209) | YASTLQS (227) | DNGYPST (228) | SYAMS (212) | SEIVATGILTSYDS (242) | SSAGFDY (230) |
| G10 | RASQSISSYLN (209) | YASTLQS (227) | DNGYPST (228) | SYAMS (212) | SSIGRQGLITVYDS (243) | SSAGFDY (230) |
| G12 | RASQSISSYLN (209) | YASTLQS (227) | DNGYPST (228) | SYAMS (212) | SSIWYQGLVTVYDS (244) | SSAGFDY (230) |
| E11 | RASQSISSYLN (209) | YASTLQS (227) | DNGYPST (228) | SYAMS (212) | SDIWKQGFATADS (245) | SSAGFDY (230) |
| D01 | RASQSISSYLN (209) | YASTLQS (227) | DNGYPST (228) | SYAMS (212) | SSIWKQGIVTVYDS (238) | SSAGFDY (230) |
| H06 | RASQSISSYLN (209) | YASTLQS (227) | DNGYPST (228) | SYAMS (212) | SSIWRQGLATAYDS (241) | SSAGFDY (230) |
| C5H9 | RASQSISSYLN (209) | YASTLQS (227) | DNGYPST (228) | SYAMS (212) | SSIWRNGIVTVYADS (246) | WSAAFDY (235) |
| C5B10 | RASQSISSYLN (209) | YASTLQS (227) | DNGYPST (228) | SYAMS (212) | SSIWRNGIVTVYADS (246) | WSAGYDY (236) |
| C5E10 | RASQSISSYLN (209) | YASTLQS (227) | DNGYPST (228) | SYAMS (212) | SSIWRNGIVTVYADS (246) | WSKGFDY (237) |
| G12H9 | RASQSISSYLN (209) | YASTLQS (227) | DNGYPST (228) | SYAMS (212) | SSIWYQGLVTVYADS (247) | WSAAFDY (235) |
| G12B10 | RASQSISSYLN (209) | YASTLQS (227) | DNGYPST (228) | SYAMS (212) | SSIWYQGLVTVYADS (247) | WSAGYDY (236) |
| G12E10 | RASQSISSYLN (209) | YASTLQS (227) | DNGYPST (228) | SYAMS (212) | SSIWYQGLVTVYADS (247) | WSKGFDY (237) |
| C5H9 v2 | RASQSISSYLN (209) | AASSLQS (215) | DNGYPST (228) | SYAMS (212) | SSIWRNGIVTVYADS (246) | WSAAFDY (235) |

In some embodiments, the activatable anti-PDL1 antibody includes a CDR sequence shown in Table 17, a combination of VL CDR sequences selected from the group consisting of those combinations shown in Table 17, and/or a combination of VH CDR sequences selected from the group consisting of those combinations shown in Table 17.

In some embodiments, the activatable anti-PDL1 antibody includes a combination of heavy chain CDR sequences selected from the group consisting of the combinations shown in Group A in Table 17. In some embodiments, the activatable anti-PDL1 antibody includes a combination of light chain CDR sequences selected from the group consisting of the combinations shown in Group A in Table 17. In some embodiments, the activatable anti-PDL1 antibody includes a combination of heavy chain CDR sequences selected from the group consisting of the combinations shown in Group A in Table 17, and a combination of light chain CDR sequences selected from the group consisting of the combinations shown in Group A in Table 17.

In some embodiments, the activatable anti-PDL1 antibody includes a combination of heavy chain CDR sequences selected from the group consisting of the combinations shown in Group B in Table 17. In some embodiments, the activatable anti-PDL1 antibody includes a combination of light chain CDR sequences selected from the group consisting of the combinations shown in Group B in Table 17. In some embodiments, the activatable anti-PDL1 antibody includes a combination of heavy chain CDR sequences selected from the group consisting of the combinations shown in Group B in Table 17, and a combination of light chain CDR sequences selected from the group consisting of the combinations shown in Group B in Table 17.

In some embodiments, the activatable anti-PDL1 antibody includes a combination of heavy chain CDR sequences selected from the group consisting of the combinations shown in Group C in Table 17. In some embodiments, the activatable anti-PDL1 antibody includes a combination of light chain CDR sequences selected from the group consisting of the combinations shown in Group C in Table 17. In some embodiments, the activatable anti-PDL1 antibody includes a combination of heavy chain CDR sequences selected from the group consisting of the combinations shown in Group C in Table 17, and a combination of light chain CDR sequences selected from the group consisting of the combinations shown in Group C in Table 17.

In some embodiments, the activatable anti-PDL1 antibody includes a combination of heavy chain CDR sequences selected from the group consisting of the combinations shown in Group D in Table 17. In some embodiments, the activatable anti-PDL1 antibody includes a combination of light chain CDR sequences selected from the group consisting of the combinations shown in Group D in Table 17. In some embodiments, the activatable anti-PDL1 antibody includes a combination of heavy chain CDR sequences selected from the group consisting of the combinations shown in Group D in Table 17, and a combination of light chain CDR sequences selected from the group consisting of the combinations shown in Group D in Table 17.

In some embodiments, the activatable anti-PDL1 antibody includes a combination of heavy chain CDR sequences selected from the group consisting of the combinations shown in Group E in Table 17. In some embodiments, the activatable anti-PDL1 antibody includes a combination of light chain CDR sequences selected from the group consisting of the combinations shown in Group E in Table 17. In some embodiments, the activatable anti-PDL1 antibody includes a combination of heavy chain CDR sequences selected from the group consisting of the combinations shown in Group E in Table 17, and a combination of light chain CDR sequences selected from the group consisting of the combinations shown in Group E in Table 17.

In some embodiments, the activatable anti-PDL1 antibody includes a combination of heavy chain CDR sequences selected from the group consisting of the combinations shown in Group F in Table 17. In some embodiments, the activatable anti-PDL1 antibody includes a combination of light chain CDR sequences selected from the group consisting of the combinations shown in Group F in Table 17. In some embodiments, the activatable anti-PDL1 antibody includes a combination of heavy chain CDR sequences selected from the group consisting of the combinations shown in Group F in Table 17, and a combination of light chain CDR sequences selected from the group consisting of the combinations shown in Group F in Table 17.

In some embodiments, the activatable anti-PDL1 antibody includes a combination of heavy chain CDR sequences selected from the group consisting of the combinations shown in Group G in Table 17. In some embodiments, the activatable anti-PDL1 antibody includes a combination of light chain CDR sequences selected from the group consisting of the combinations shown in Group G in Table 17. In some embodiments, the activatable anti-PDL1 antibody includes a combination of heavy chain CDR sequences selected from the group consisting of the combinations shown in Group G in Table 17, and a combination of light chain CDR sequences selected from the group consisting of the combinations shown in Group G in Table 17.

In some embodiments, the activatable anti-PDL1 antibody includes a combination of heavy chain CDR sequences selected from the group consisting of the combinations shown in Group H in Table 17. In some embodiments, the activatable anti-PDL1 antibody includes a combination of light chain CDR sequences selected from the group consisting of the combinations shown in Group H in Table 17. In some embodiments, the activatable anti-PDL1 antibody includes a combination of heavy chain CDR sequences selected from the group consisting of the combinations shown in Group H in Table 17, and a combination of light chain CDR sequences selected from the group consisting of the combinations shown in Group H in Table 17.

In some embodiments, the activatable anti-PDL1 antibody includes a combination of heavy chain CDR sequences selected from the group consisting of the combinations shown in Group I in Table 17. In some embodiments, the activatable anti-PDL1 antibody includes a combination of light chain CDR sequences selected from the group consisting of the combinations shown in Group I in Table 17. In some embodiments, the activatable anti-PDL1 antibody includes a combination of heavy chain CDR sequences selected from the group consisting of the combinations shown in Group I in Table 17, and a combination of light chain CDR sequences selected from the group consisting of the combinations shown in Group I in Table 17.

In some embodiments, the activatable anti-PDL1 antibody includes a combination of heavy chain CDR sequences selected from the group consisting of the combinations shown in Group J in Table 17. In some embodiments, the activatable anti-PDL1 antibody includes a combination of light chain CDR sequences selected from the group consisting of the combinations shown in Group J in Table 17. In some embodiments, the activatable anti-PDL1 antibody includes a combination of heavy chain CDR sequences selected from the group consisting of the combinations shown in Group J in Table 17, and a combination of light chain CDR sequences selected from the group consisting of the combinations shown in Group J in Table 17.

In some embodiments, the activatable anti-PDL1 antibody includes a combination of heavy chain CDR sequences selected from the group consisting of the combinations shown in Group K in Table 17. In some embodiments, the activatable anti-PDL1 antibody includes a combination of light chain CDR sequences selected from the group consisting of the combinations shown in Group K in Table 17. In some embodiments, the activatable anti-PDL1 antibody includes a combination of heavy chain CDR sequences selected from the group consisting of the combinations shown in Group K in Table 17, and a combination of light chain CDR sequences selected from the group consisting of the combinations shown in Group K in Table 17.

In some embodiments, the activatable anti-PDL1 antibody includes a combination of heavy chain CDR sequences selected from the group consisting of the combinations shown in Group L in Table 17. In some embodiments, the activatable anti-PDL1 antibody includes a combination of light chain CDR sequences selected from the group consisting of the combinations shown in Group L in Table 17. In some embodiments, the activatable anti-PDL1 antibody includes a combination of heavy chain CDR sequences selected from the group consisting of the combinations shown in Group L in Table 17, and a combination of light chain CDR sequences selected from the group consisting of the combinations shown in Group L in Table 17.

In some embodiments, the activatable anti-PDL1 antibody includes a combination of heavy chain CDR sequences selected from the group consisting of the combinations shown in Group M in Table 17. In some embodiments, the activatable anti-PDL1 antibody includes a combination of light chain CDR sequences selected from the group consisting of the combinations shown in Group M in Table 17. In some embodiments, the activatable anti-PDL1 antibody includes a combination of heavy chain CDR sequences selected from the group consisting of the combinations shown in Group M in Table 17, and a combination of light chain CDR sequences selected from the group consisting of the combinations shown in Group M in Table 17.

In some embodiments, the activatable anti-PDL1 antibody includes a combination of heavy chain CDR sequences selected from the group consisting of the combinations shown in Group N in Table 17. In some embodiments, the activatable anti-PDL1 antibody includes a combination of light chain CDR sequences selected from the group consisting of the combinations shown in Group N in Table 17. In some embodiments, the activatable anti-PDL1 antibody includes a combination of heavy chain CDR sequences selected from the group consisting of the combinations shown in Group N in Table 17, and a combination of light chain CDR sequences selected from the group consisting of the combinations shown in Group N in Table 17.

In some embodiments, the activatable anti-PDL1 antibody includes a combination of heavy chain CDR sequences selected from the group consisting of the combinations shown in Group 0 in Table 17. In some embodiments, the activatable anti-PDL1 antibody includes a combination of light chain CDR sequences selected from the group consisting of the combinations shown in Group 0 in Table 17. In some embodiments, the activatable anti-PDL1 antibody includes a combination of heavy chain CDR sequences selected from the group consisting of the combinations shown in Group 0 in Table 17, and a combination of light chain CDR sequences selected from the group consisting of the combinations shown in Group 0 in Table 17.

In some embodiments, the activatable anti-PDL1 antibody includes a heavy chain CDR1 sequence selected from the group consisting of the sequences shown in Group P in Table 17.

TABLE 17

Additional CDR Sequences for Antibodies and Activatable Antibodies that Bind PDL1

| VL | | | VH | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| Group A | | | | | |
| RASQSVSSYLV (304) | DASNRAT (293) | QQRSNWPRT (278) | DYGFS (296) | WITAYNGNTNYAQKLQG (284) | DYFYGMDV (269) |
| RASQSVSSYLA (305) | AASSLQS (215) | QQRSNWPT (279) | TYAIS (297) | GIIPIFGKAHYAQKFQG (285) | KFHFVSGSPFGMDV (270) |
| RASQGISSWLA (306) | GASSRAT (294) | QQYNSYPYT (280) | SYDVH (298) | WLHADTGITKFSQKFQG (286) | ERIQLWFDY (271) |
| RASQSVSSYLA (307) | DASSLES (295) | QQYGSSPWT (281) | TYAIN (299) | GIIPIFGTANHAQKFQG (287) | DQGIAAALFDY (272) |
| RASQGISSALA (308) | KASTLES (447) | QQYGSSP (282) | DYVVH (300) | GISGNSGNIGYADSVKG (288) | PFDY (273) |
| | | QQFNSYPET (283) | SYAIS (301) | GIIPIFGRAHYAQKFQG (289) | KYDYVSGSPFGMDV (274) |
| | | QQSYSTPWT (448) | SYAIN (302) | GIIPIFGSANYAQKFQD (290) | DSSGWSRYYMDV (275) |
| | | | DYGMH (303) | GIIPLFGIAHYAQKFQG (291) | KYSYVSGSPFGMDV (276) |

TABLE 17-continued

Additional CDR Sequences for Antibodies and Activatable Antibodies that Bind PDL1

| VL | | | VH | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| | | | | GISWNRGRIEYADSVKG (292) | GRFRYFDWFLDY (277) |
| | | | | | DYFWSGFSAFDI (446) |
| Group B | | | | | |
| SGDALPQKYVF (312) | EDSKRPS (313) | YSTDRSGNHRV (314) | TYSMN (309) | SISSSGDYIYYADSVK (310) | DLVTSMVAFDY (311) |
| RASQRVSSSYLA (318) | DASSRAT (319) | QQYGSLPWT (320) | RYWMS (315) | NIKQDGSEKYYVDSVKG (316) | EGGWFGELAFDY (317) |
| RASQSVSSNYLA (324) | GTSSRAT (325) | QQYGSSIFT (326) | SYWMS (321) | NIKQDGGEQYYVDSVK (322) | DWNYGYYDMDV (323) |
| Group C | | | | | |
| RASQ(D/V)(V/I)(S/N)T(A/F)(V/L)A (327) | SAS(F/T)L(Y/A)S (328) | QQ(Y/G/F/S)(L/Y/F/W)(Y/N/A/T/G/F/I)(H/V/P/T/I)P(A/W/R/P/T)T (329) | GFTFS(D/G)SWIH (330) | AWI(S/L)PYGGS(T/S)YYADSVKG (331) | RHWPGGFDY (332) |
| RASQDVSTAVA (333) | SASFLYS (334) | QQYLYHPAT (335) | GFTFSDSWIH (336) | AWISPYGGSTYYADSVKG (337) | |
| Group D | | | | | |
| KSSQSLL(H/N)(S/T)(R/S)TRKNYLA (588) | WASTRES (589) | (Q/K)QSYDVVT (590) | SYW(I/M)H (591) | YINPSS(D/G)Y(H/K)EY(S/N)(E/Q)KF(I/M)D (592) | SGWL(I/V)HGDYYFD(F/Y) (593) |
| KSSQSLLNSRTRKNYLA (594) | | QQSYDVVT (595) | SYWMH (596) | YINPSSDYNEYSEKFMD (597) | SGWLVHGDYYFDY (598) |
| KSSQSLLHTSTRKNYLA (599) | | KQSYDVVT (600) | GYIFTSYWMH (601) | YINPSSGYHEYNQKFID (602) | SGWLIHGDYYFDF (603) |
| | | | SYWIH (604) | | |
| | | | GTTFTSYWIH (605) | | |
| Group E | | | | | |
| TGT(N/S)(T/R/S)DVG(A/G)YNYVS (606) | (E/D)V(I/N/D)(D/H/N)RPS (607) | SS(F/Y)T(N/S)(R/T/S)(G/S)(I/T)RV (608) | (K/R/T/Q/G/A/W/M/I/S)Y(V/R/K/L/M/I)M(H/T/N/Q/A/V/Y/W/F/M) (609) | SIYPSGG(F/I)TFYAD(S/T)VKG (610) | IKLGTVTTV(E/D)Y (611) |
| TGTSSDVGGYNYVS (612) | DVSNRPS (613) | SSYTSSSTRV (614) | SYIMM (615) | SIYPSGGITFYADTVKG (617) | IKLGTVTTVDY (618) |
| Group F | | | | | |
| | | | MYMMM (619) | SIYPSGGITFYADSVKG (620) | TGTSSDVGAYNYVS (621) |

TABLE 17-continued

Additional CDR Sequences for Antibodies and
Activatable Antibodies that Bind PDL1

| VL | | | VH | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |

Group G

| (R/S/K)(A/S)S (R/N/D/Q/E/H/K/M/S)(SLLYSS or Absent)(N/D or Absent)(A/Q/E/L/K/M/P/S/T/Y/V)X(R/N/S/T)(A/R/N/C/Q/E/H/I/L/K/M/F/S/T/Y/V)(I/L/M/V)(A/R/N/Q/E/H/I/K/M/F/S/T/Y) (622) | X(A/C/G/S/T/V)(A/C/H/I/L/M/F/S/T/Y/V)(R/N/D/C/Q/E/K/S/T)(A/R/N/D/Q/E/G/H/K/T/Y)(A/N/S/T) (623) | (R/N/Q/E/H)QX(A/R/N/C/Q/E/H/I/L/K/M/F/S/T/Y/V)(N/G/S)(A/E/G/H/I/L/K/M/F/R/S/T/W/Y/V)P(A/R/N/D/Q/E/G/H/K/M/P/S/T/Y) T (624) | G(Y/F)(T/S)(I/L/M/F)(A/R/N/D/C/Q/E/H/I/L/K/M/P/S/T/W/Y/V)(N/D/Q/E/K/P/S/T)(A/R/N/D/C/Q/E/G/H/F/P/S/T/Y/V)(A/R/N/D/C/Q/E/G/H/I/L/K/M/F/P/S/T/Y/V)(A/R/C/Q/E/H/I/L/K/M/F/S/T/W/Y/V)N (625) | X(I/L/M/F/V)X(P or Absent)(A/R/N/Q/E/H/K/M/S/T/Y/V)(A/R/N/D/C/Q/E/G/H/K/M/F/P/S/T/Y/V)(N/G/S)(N/G/S)T(A/R/N/Q/S)(N/G/S)T(A/R/N/Q/E/H/K/M/S/T/Y)(A/R/N/C/Q/E/H/I/L/K/M/F/S/T/W/Y/V)N(A/N/D/C/Q/E/G/H/I/L/K/M/F/P/S/T/Y/V)(I/L/M/F)K(A/G/S) (626) | (A/R/N/Q/E/H/K/M/S/T/Y)(A/R/N/D/C/Q/E/G/H/K/M/Y/V)(Q/G/H/T/W)XXX(F/Y)(AI or Absent) (627) |
| RASSSVSYIY (628) | ATFNLAS (629) | HQRSSYPWT (630) | GYTFPDYYMN (631) | DIDPNYGGTTYNQKFKG (632) | GAL (633) |
| SASSSIRYMH (634) | DTSKLTS (635) | QQDSSYPLT (636) | GYTFTSYDIN (637) | WIFPRDNNTKYNSNFKG (638) | ENWVGDF (639) |
| KASQDVGTAVA (640) | WASTRHT (641) | QQYYGYPLT (642) | GYSITSDYWN (643) | YISYTGSTYYNPSLKS (644) | YGGWLSPF (645) |
| KSSQSLLYSSNQKNSL (646) | WASTRES (589) | | GYSIISDYWN (647) | | RGGWLLPF (648) |
| | | | GFSLTTYSIN (649) | VMWAGGGTNSNSVLKS (650) | YYGNSPYYAI (651) |

Group H

| TRSSGSIGSNYVQ (652) | EDNQRPS (653) | QSYD3STWV (654) | SYAIS (301) | WISPIGGSTNYAQKVQG (655) | GLXXXXXXXXXXXXXXDV (656) |
| TRSSGNIASNYVQ (657) | GKNNRPS (658) | QSYDSSNLWV (659) | SYGIS (660) | WISAYNGNTNYAQKLED (661) | ALPSGTILVGGWFDP (662) |
| QGDSLRSYYAS (663) | SDRDRPS (664) | NSRDSSGNHYV (665) | SYALS (666) | AISGGGGSTYYADSVKD (667) | DVFPETFSMNYGMDV (668) |
| GGSDIGRKSVH (669) | DVSNRPS (613) | QVWDNNSDHYV (670) | DYAMH (671) | LISGDGGSTYYADSVKD (672) | VLLPCSSTSCYGSVGAFDI (673) |
| TGTSSDVGGYNYVS (612) | GASSRAT (294) | SSYTSSTLP (674) | NYDMS (675) | RVNWNGGSTTYADAVKD (676) | EFVGAIDL (677) |
| RASQSIGNSLA (678) | AASTLQS (679) | QQHTIPTES (680) | GLYIH (681) | WIIPIEGTANYAQKFED (682) | GLRWGIWGWFDP (683) |
| RASQGIGSYLA (684) | QDIKRPS (685) | QQLNNYPIT (686) | DNAIS (687) | WIIPIFGKPNYAQKFED (688) | TMVRGFLGVMDV (689) |
| SGDKLGNKYAY (690) | EDYRRPS (691) | QTWDNSVV (692) | SYAMS (212) | AISGSGGSTYYADSVKD (693) | DQFVTIFGVPRYGMDV (694) |
| TRSSGSIDSNYVQ (695) | DDSDRPS (696) | QSYDSNNRHVI (697) | TYALN (698) | RIVPLIGLVNYAHNFED (699) | GRQMFGAGIDF (700) |

TABLE 17-continued

Additional CDR Sequences for Antibodies and
Activatable Antibodies that Bind PDL1

| VL | | | VH | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| TRSSGNIGTNYVQ (701) | EDNKRPS (702) | QSYHSSGWE (703) | SHGIT (704) | WISAHNGHASNAQKVED (705) | EVYGGNSDY (706) |
| GGNNIGSKGVH (707) | YKSDSNKQQAS (708) | QVWDSSSDHWV (709) | RHGMH (710) | VISHDGSVKYYADSMKD (711) | VHAALYYGMDV (712) |
| TRSSGSIASNYVQ (713) | | QSYDSTTPSV (714) | | WTSPHNGLTAFAQILED (715) | GLSYQVSGWFDP (716) |
| TRSSGSIASHYVQ (717) | | QSYDGITVI (718) | | RIIPILGIANYAQKFED (719) | VHPVFSYALDV (720) |
| TLRSGLNVGSYRIY (721) | | QSYDSSNRWV (722) MIWYSSAVV (726) | TYAFS (723) NYGIS (727) | WISAYNGNTNYAQKVED (724) | DGYGSDPVL (725) GDFRKPFDY (728) |
| Group I | | | | | |
| RATESVEYYGTSLVQ (729) | AASSVDS (730) | QQSRRVPYT (731) | SYVMH (732) | YVNPENDGTKYNEMFKG (733) | QAWGYP (734) |
| Group J | | | | | |
| RASQDVSTAVA (333) | SASFLYS (334) | QQYLYHPAT (335) | GFTFSDSWIH (336) | AWISPYGGSTYYADSVKG (337) | RHWPGGFDY (332) |
| Group K | | | | | |
| QSISNW (781) | KAS (782) | QQYHSYSYT (783) | GFTFSRFW (784) | INQDGTEK (785) | ANTYYDFWSGHFDY (786) |
| QGIRND (787) | TAS (788) | LQHNSYPLT (789) | GFTFSNFG (790) | LWSDGSNK (791) | ARGRGAPGIPIFGY (792) |
| QGIRND (787) | AAS (793) | LQHNNYPYT (794) | GFTFSNAW (795) | IKRKTDGGTT (796) | TTDDIVVVPAVMREYYFGMDV (797) |
| QTLVHGDGNTY (798) | KVS (799) | MQATHFPIT (800) | GYSFTGYY (801) | INPNSGTK (802) | ARDEDWNFGSWFDS (803) |
| PSLVHSDGNTY (804) | KIS (805) | MQATHFPIT (800) | GYTFTGYY (806) | LNPNTGTT (807) | ARDEDWNYGSWFDT (808) |
| QSINSY (809) | VAS (810) | QQSYSTPPIT (811) | GFTFDDYG (812) | IHWHGKRT (813) | VRGGMSTGDWFDP (814) |
| QSISSY (815) | VAS (810) | QQSYSTPPIT (811) | GFTFDDYG (812) | IHWSGRST (816) | ARGGMSTGDWFDP (817) |
| QTINIY (818) | AAS (793) | HQSYSTPPIT (819) | GFTVGSNY (820) | IYSGGST (821) | ARGIRGLDV (822) |
| QSMSSY (1011) | AAS (793) | QQSYSTPPIT (811) | GITVGTNY (1012) | ISSGGNT (1013) | ARGIRGLDV (822) |
| QSFNFNY (823) | GAS (824) | QQYESAPWT (825) | GGIFSSST (826) | IIPVFGTV (827) | ARNWGLGSFYI (828) |
| QSISSY (815) | AAS (793) | QQSYCTPPIT (829) | GFPFDEYA (830) | ISWSNNNI (831) | AKSGIFDS (832) |
| QSISSY (815) | AAS (793) | QQSYSTPPIT (811) | GFTFSSYG (833) | ISYEGRNK (834) | AKDRTLYGMDV (835) |
| QVISNY (836) | AAS (793) | QKYNSAPRT (837) | GFSLSTNRMC (838) | IDWDGVK (839) | ARSTSLTFYYFDY (840) |

TABLE 17-continued

Additional CDR Sequences for Antibodies and
Activatable Antibodies that Bind PDL1

| VL | | | VH | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| QNINNY (841) | AAS (793) | QQSYNTPLT (842) | EFTVGTNH (843) | IYSGGNT (844) | ARGLGGMDV (845) |
| QTISTY (846) | AAS (793) | LQHNSYPYT (847) | GFTFSKYW (848) | IKGDGSEK (849) | ARDYWGSGYYFDF (850) |
| QSISSY (815) | VVS (851) | QQSYSTPFT (852) | GFTFSSYW (853) | IKQDGSEK (854) | ARDDIVVVPAPMGYYYYYFGMDV (855) |
| | AAS (793) | QQSYSTPPIT (811) | GFTFDDFA (856) | ISWTGGNM (857) | VKDIRGIVATGGAFDI (858) |
| | | | GFTVGTNY (859) | IYSGGST (821) | ARGIRGFDI (860) |
| | | | GFTISTNY (861) | IYSSGST (862) | ARGIRGFDI (860) |
| | | | GFTIDDSA (863) | ISWKSGSI (864) | VKDIRGNWNYGGNWFDP (865) |
| | | | GFTVGVNH (866) | IFSSGRT (867) | ARGIGGLDI (868) |
| | | | GFTFDDYA (869) | ISWTGGTI (870) | TRDIRGNWKYGGWFDP (871) |
| | | | GYTFTAYY (872) | ISPNSGFT (873) | AREGSTHHNSFDP (874) |
| | | | GFTVGTNF (875) | IIPILGAA (876) | ARGGGMDV (877) |
| | | | GGTFNTYV (878) | ISPYNGYT (879) | ARDRTSGGFDP (880) |
| | | | GYIFTHYG (881) | | SPGRGPYWSFDL (882) |
| Group L | | | | | |
| QASESVYSNNYLS (1014) | LASTLAS (1015) | IGGKSSSTDGNA (1016) | SNGLT (1017) | TINKDASAYYASWAKG (1018) | IAFKTGTSI (1019) |
| Group M | | | | | |
| RSSKSLLHSNGITYLY (1020) | QMSNLAS (1021) | AQNLEPPLT (1022) | DYYTH (1023) | WIDPENGKTAYAPKFQG (1024) | GGYDVYFLDY (1025) |
| Group N | | | | | |
| KASQDVGIVVA (1026) | WASIRHT (1027) | QQYSNYPLYT (1028) | GFSLTSYGVH (1029) | VIWAGGSTNYNSALMS (1030) | AKPYGNSAMDY (1031) |
| | | | | VIWAGGSTNYVDSVKG (1032) | AKPYGTSAMDY (1033) |
| | | | | VIWAGGSTNYADSVKG (1034) | |
| Group O | | | | | |
| ASQSVSTSSSSFMH (1035) | YASNLES (1036) | QHSWEIPYT (1037) | SYGMS (1038) | SISSGGSTYYPDSVKG (1039) | GYDSGFAY (1040) |
| RASQSVSTSSSSYMH (1041) | YASNLES (1036) | QHSWEIPYT (1037) | SYGMS (1038) | SISSGGTTYYPDSVKG (1042) | GYDSGFAY (1040) |

TABLE 17-continued

Additional CDR Sequences for Antibodies and
Activatable Antibodies that Bind PDL1

| VL | | | VH | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| KASQSVSNDVA (1043) | YAANRYT (1044) | QQDYTSPYT (1045) | TYGVH (1046) | VIWRGVTTDYNAAFMAS (1047) | LGFYAMDY (1048) |
| KASQSVSNDVG (1049) | YASNRYS (1050) | QQDYTSPYT (1045) | SYGVH (1051) | VIWSGGVTDYNAAFIS (1052) | LGFYAMDY (1048) |
| RSSQIIVHSNANTYLE (1053) | KVSNRFS (1054) | FQGSHVPYT (1055) | TYWMH (1056) | QINPDSTTINTAPSLKD (1057) | PGDYGYDFDC (1058) |
| SASSSVSSSYLY (1059) | NTSNLAS (1060) | HQWRSYPPT (1061) | SGYWN (1062) | YISYSGSTYYNPSLKS (1063) | SLLWFSTGFAY (1064) |
| SANSSVSYMH (1065) | DTSKLAS (1066) | QQWSSNPWT (1067) | SYGVH (1051) | YIWGGITDYNAAFKS (1068) | LGFYAMDY (1048) |
| RASQSVSTSSYSYMH (1069) | YASNLES (1036) | QNSWEIPYT (1070) | STGMS (1071) | SISSGGTTYYLGSVQG (1072) | GYDAGFAY (1073) |
| KSSQSLLYSSNQKNSLA (1074) | WASNRES (1075) | QQYYSYPLT (1076) | SGYWT (1077) | YIYTGSTYYNPSLKS (1078) | QRDWLGFAY (1079) |
| RASQSVSTSSYSYVH (1080) | YASNLES (1036) | QHSWEIPYT (1037) | SYGMS (1038) | SISSGGSIYYPDSVKG (1081) | GYDAGFAF (1082) |

Group P

GFTFSMYMMM (1083)

GFTFSAYAMA (1084)

GFTFSAYRMF (1085)

GFTFSAYLMV (1086)

GFTFSAYVMF (1087)

GFTFSAYVMS (1088)

GFTFSGYLMV (1089)

GFTFSGYQML (1090)

GFTFSGYSMF (1091)

GFTFSGYWMA (1092)

GFTFSQYLMY (1093)

GFTFSQYVMF (1094)

GFTFSQYYMY (1095)

GFTFSSYLMS (1096)

TABLE 17-continued

Additional CDR Sequences for Antibodies and Activatable Antibodies that Bind PDL1

| VL | | | VH | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| | | | GFTFSSYLMT (1097) | | |
| | | | GFTFSSYQMV (1098) | | |
| | | | GFTFSSYSMA (1099) | | |
| | | | GFTFSSYVMF (1100) | | |
| | | | GFTFSSYVMS (1101) | | |
| | | | GFTFSSYVMY (1102) | | |
| | | | GFTFSSYYMF (1103) | | |
| | | | GFTFSSYYMV (1104) | | |
| | | | GFTFSYYSMV (1105) | | |
| | | | GFTFSWYLMA (1106) | | |
| | | | GFTFSWYQMS (1107) | | |

The ABs in the activatable antibodies of the disclosure specifically bind a PDL1 target, such as, for example, mammalian PDL1, and/or human PDL1. Also included in the disclosure are ABs that bind to the same PDL1 epitope as an antibody of the disclosure and/or an activated activatable antibody described herein. Also included in the disclosure are ABs that compete with an anti-PDL1 antibody and/or an activated anti-PDL1 activatable antibody described herein for binding to a PDL1 target, e.g., human PDL1. Also included in the disclosure are ABs that cross-compete with an anti-PDL1 antibody and/or an activated anti-PDL1 activatable antibody described herein for binding to a PDL1 target, e.g., human PDL1.

The activatable anti-PDL1 antibodies provided herein include a masking moiety. In some embodiments, the masking moiety is an amino acid sequence that is coupled or otherwise attached to the anti-PDL1 antibody and is positioned within the activatable anti-PDL1 antibody construct such that the masking moiety reduces the ability of the anti-PDL1 antibody to specifically bind PDL1. Suitable masking moieties are identified using any of a variety of known techniques. For example, peptide masking moieties are identified using the methods described in PCT Publication No. WO 2009/025846 by Daugherty et al., the contents of which are hereby incorporated by reference in their entirety.

The activatable anti-PDL1 antibodies provided herein include a cleavable moiety. In some embodiments, the cleavable moiety includes an amino acid sequence that is a substrate for a protease, usually an extracellular protease. Suitable substrates are identified using any of a variety of known techniques. For example, peptide substrates are identified using the methods described in U.S. Pat. No. 7,666,817 by Daugherty et al.; in U.S. Pat. No. 8,563,269 by Stagliano et al.; and in PCT Publication No. WO 2014/026136 by La Porte et al., the contents of each of which are hereby incorporated by reference in their entirety. (See also Boulware et al. "Evolutionary optimization of peptide substrates for proteases that exhibit rapid hydrolysis kinetics." Biotechnol Bioeng. 106.3 (2010): 339-46).

Exemplary substrates include but are not limited to substrates cleavable by one or more of the following enzymes or proteases listed in Table 12.

TABLE 12

Exemplary Proteases and/or Enzymes

| ADAMS, ADAMTS, e.g. | Cysteine proteinases, e.g., | Serine proteases, e.g., |
|---|---|---|
| ADAM8 | Cruzipain | activated protein C |
| ADAM9 | Legumain | Cathepsin A |
| ADAM10 | Otubain-2 | Cathepsin G |
| ADAM12 | | Chymase |
| ADAM15 | KLKs, e.g., | coagulation factor proteases |
| ADAM17/TACE | KLK4 | (e.g., FVIIa, FIXa, FXa, |
| ADAMDEC1 | KLK5 | FXIa, FXIIa) |
| ADAMTS1 | KLK6 | Elastase |
| ADAMTS4 | KLK7 | Granzyme B |
| ADAMTS5 | KLK8 | Guanidinobenzotase |
| | KLK10 | HtrA1 |

TABLE 12-continued

| Exemplary Proteases and/or Enzymes | | |
|---|---|---|
| Aspartate proteases, e.g., | KLK11 | Human Neutrophil Elastase |
| BACE | KLK13 | Lactoferrin |
| Renin | KLK14 | Marapsin |
| | | NS3/4A |
| Aspartic cathepsin, e.g., | Metallo proteinases, e.g., | PACE4 |
| Cathepsin D | Meprin | Plasmin |
| Cathepsin E | Neprilysin | PSA |
| | PSMA | tPA |
| Caspases, e.g., | BMP-1 | Thrombin |
| Caspase 1 | | Tryptase |
| Caspase 2 | MMPs, e.g., | uPA |
| Caspase 3 | MMP1 | |
| Caspase 4 | MMP2 | Type II Transmembrane |
| Caspase 5 | MMP3 | Serine Proteases (TTSPs), e.g., |
| Caspase 6 | MMP7 | DESC1 |
| Caspase 7 | MMP8 | DPP-4 |
| Caspase 8 | MMP9 | FAP |
| Caspase 9 | MMP10 | Hepsin |
| Caspase 10 | MMP11 | Matriptase-2 |
| Caspase 14 | MMP12 | MT/SP1/Matriptase |
| | MMP13 | TMPRSS2 |
| Cysteine cathepsin, e.g., | MMP14 | TMPRSS3 |
| Cathepsin B | MMP15 | TMPRSS4 |
| Cathepsin C | MMP16 | |
| Cathepsin K | MMP17 | |
| Cathepsin L | MMP19 | |
| Cathepsin S | MMP20 | |
| Cathepsin V/L2 | MMP23 | |
| Cathepsin X/Z/P | MMP24 | |
| | MMP26 | |
| | MMP27 | |

The activatable anti-PDL1 antibodies described herein overcome a limitation of antibody therapeutics, particularly antibody therapeutics that are known to be toxic to at least some degree in vivo. Target-mediated toxicity constitutes a major limitation for the development of therapeutic antibodies. The activatable anti-PDL1 antibodies provided herein are designed to address the toxicity associated with the inhibition of the target in normal tissues by traditional therapeutic antibodies. These activatable anti-PDL1 antibodies remain masked until proteolytically activated at the site of disease. Starting with an anti-PDL1 antibody as a parental therapeutic antibody, the activatable anti-PDL1 antibodies of the invention were engineered by coupling the antibody to an inhibitory mask through a linker that incorporates a protease substrate.

When the AB is modified with a MM and is in the presence of the target, specific binding of the AB to its target is reduced or inhibited, as compared to the specific binding of the AB not modified with an MM or the specific binding of the parental AB to the target.

The $K_d$ of the AB modified with a MM towards the target is at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times greater than the $K_d$ of the AB not modified with an MM or of the parental AB towards the target. Conversely, the binding affinity of the AB modified with a MM towards the target is at least 2, 3, 4, 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times lower than the binding affinity of the AB not modified with an MM or of the parental AB towards the target.

In some embodiments, the dissociation constant ($K_d$) of the MM towards the AB is generally greater than the $K_d$ of the AB towards the target. The $K_d$ of the MM towards the AB can be at least 5, 10, 25, 50, 100, 250, 500, 1,000, 2,500, 5,000, 10,000, 100,000, 1,000,000 or even 10,000,000 times greater than the $K_d$ of the AB towards the target. Conversely, the binding affinity of the MM towards the AB is generally lower than the binding affinity of the AB towards the target. The binding affinity of MM towards the AB can be at least 5, 10, 25, 50, 100, 250, 500, 1,000, 2,500, 5,000, 10,000, 100,000, 1,000,000 or even 10,000,000 times lower than the binding affinity of the AB towards the target.

In some embodiments, the dissociation constant ($K_d$) of the MM towards the AB is approximately equal to the $K_d$ of the AB towards the target. In some embodiments, the dissociation constant ($K_d$) of the MM towards the AB is no more than the dissociation constant of the AB towards the target.

In some embodiments, the dissociation constant ($K_d$) of the MM towards the AB is less than the dissociation constant of the AB towards the target.

In some embodiments, the dissociation constant ($K_d$) of the MM towards the AB is greater than the dissociation constant of the AB towards the target.

In some embodiments, the MM has a $K_d$ for binding to the AB that is no more than the $K_d$ for binding of the AB to the target.

In some embodiments, the MM has a $K_d$ for binding to the AB that is no less than the $K_d$ for binding of the AB to the target.

In some embodiments, the MM has a $K_d$ for binding to the AB that is approximately equal to the $K_d$ for binding of the AB to the target.

In some embodiments, the MM has a $K_d$ for binding to the AB that is less than the $K_d$ for binding of the AB to the target.

In some embodiments, the MM has a $K_d$ for binding to the AB that is greater than the $K_d$ for binding of the AB to the target.

In some embodiments, the MM has a $K_d$ for binding to the AB that is no more than 2, 3, 4, 5, 10, 25, 50, 100, 250, 500, or 1,000 fold greater than the $K_d$ for binding of the AB to the target. In some embodiments, the MM has a $K_d$ for binding to the AB that is between 1-5, 2-5, 2-10, 5-10, 5-20, 5-50, 5-100, 10-100, 10-1,000, 20-100, 20-1000, or 100-1,000 fold greater than the $K_d$ for binding of the AB to the target.

In some embodiments, the MM has an affinity for binding to the AB that is less than the affinity of binding of the AB to the target.

In some embodiments, the MM has an affinity for binding to the AB that is no more than the affinity of binding of the AB to the target.

In some embodiments, the MM has an affinity for binding to the AB that is approximately equal of the affinity of binding of the AB to the target.

In some embodiments, the MM has an affinity for binding to the AB that is no less than the affinity of binding of the AB to the target.

In some embodiments, the MM has an affinity for binding to the AB that is greater than the affinity of binding of the AB to the target.

In some embodiments, the MM has an affinity for binding to the AB that is 2, 3, 4, 5, 10, 25, 50, 100, 250, 500, or 1,000 less than the affinity of binding of the AB to the target. I In some embodiments, the MM has an affinity for binding to the AB that is between 1-5, 2-5, 2-10, 5-10, 5-20, 5-50, 5-100, 10-100, 10-1,000, 20-100, 20-1000, or 100-1,000 fold less than the affinity of binding of the AB to the target. In some embodiments, the MM has an affinity for binding to the AB that is 2 to 20 fold less than the affinity of binding of the AB to the target. In some embodiments, a MM not covalently linked to the AB and at equimolar concentration to the AB does not inhibit the binding of the AB to the target.

When the AB is modified with a MM and is in the presence of the target specific binding of the AB to its target is reduced or inhibited, as compared to the specific binding of the AB not modified with an MM or the specific binding of the parental AB to the target. When compared to the binding of the AB not modified with an MM or the binding of the parental AB to the target the AB's ability to bind the target when modified with an MM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, or 96 hours, or 5, 10, 15, 30, 45, 60, 90, 120, 150, or 180 days, or 1, 2, 3, 4, 5, 6, 7, 8, 9, 10, 11, or 12 months or more when measured in vivo or in an in vitro assay.

The MM inhibits the binding of the AB to the target. The MM binds the antigen binding domain of the AB and inhibits binding of the AB to the target. The MM can sterically inhibit the binding of the AB to the target. The MM can allosterically inhibit the binding of the AB to its target. In these embodiments when the AB is modified or coupled to a MM and in the presence of target there is no binding or substantially no binding of the AB to the target, or no more than 0.001%, 0.01%, 0.1%, 1%, 2%, 3%, 4%, 5%, 6%, 7%, 8%, 9%, 10%, 15%, 20%, 25%, 30%, 35%, 40%, or 50% binding of the AB to the target, as compared to the binding of the AB not modified with an MM, the parental AB, or the AB not coupled to an MM to the target, for at least 2, 4, 6, 8, 12, 28, 24, 30, 36, 48, 60, 72, 84, or 96 hours, or 5, 10, 15, 30, 45, 60, 90, 120, 150, or 180 days, or 1, 2, 3, 4, 5, 6, 7, 8, 9, 10, 11, or 12 months or longer when measured in vivo or in an in vitro assay.

When an AB is coupled to or modified by a MM, the MM 'masks' or reduces or otherwise inhibits the specific binding of the AB to the target. When an AB is coupled to or modified by a MM, such coupling or modification can effect a structural change that reduces or inhibits the ability of the AB to specifically bind its target.

An AB coupled to or modified with an MM can be represented by the following formulae (in order from an amino (N) terminal region to carboxyl (C) terminal region:
(MM)-(AB)
(AB)-(MM)
(MM)-L-(AB)
(AB)-L-(MM)
where MM is a masking moiety, the AB is an antibody or antibody fragment thereof, and the L is a linker. In many embodiments, it may be desirable to insert one or more linkers, e.g., flexible linkers, into the composition so as to provide for flexibility.

In certain embodiments, the MM is not a natural binding partner of the AB. In some embodiments, the MM contains no or substantially no homology to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% similar to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% identical to any natural binding partner of the AB. In some embodiments, the MM is no more than 25% identical to any natural binding partner of the AB. In some embodiments, the MM is no more than 50% identical to any natural binding partner of the AB. In some embodiments, the MM is no more than 20% identical to any natural binding partner of the AB. In some embodiments, the MM is no more than 10% identical to any natural binding partner of the AB.

In some embodiments, the activatable antibodies include an AB that is modified by an MM and also includes one or more cleavable moieties (CM). Such activatable antibodies exhibit activatable/switchable binding, to the AB's target. Activatable antibodies generally include an antibody or antibody fragment (AB), modified by or coupled to a masking moiety (MM) and a modifiable or cleavable moiety (CM). In some embodiments, the CM contains an amino acid sequence that serves as a substrate for at least one protease.

The elements of the activatable antibodies are arranged so that the MM and CM are positioned such that in a cleaved (or relatively active) state and in the presence of a target, the AB binds a target while the activatable antibody is in an uncleaved (or relatively inactive) state in the presence of the target, specific binding of the AB to its target is reduced or inhibited. The specific binding of the AB to its target can be reduced due to the inhibition or masking of the AB's ability to specifically bind its target by the MM.

The $K_d$ of the AB modified with a MM and a CM towards the target is at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times greater than the $K_d$ of the AB not modified with an MM and a CM or of the parental AB towards the target. Conversely, the binding affinity of the AB modified with a MM and a CM towards the target is at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times lower than the binding affinity of the AB not modified with an MM and a CM or of the parental AB towards the target.

When the AB is modified with a MM and a CM and is in the presence of the target but not in the presence of a modifying agent (for example at least one protease), specific binding of the AB to its target is reduced or inhibited, as compared to the specific binding of the AB not modified with an MM and a CM or of the parental AB to the target. When compared to the binding of the parental AB or the binding of an AB not modified with an MM and a CM to its target, the AB's ability to bind the target when modified with an MM and a CM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, or 96 hours or 5, 10, 15, 30, 45, 60, 90, 120, 150, or 180 days, or 1, 2, 3, 4, 5, 6, 7, 8, 9, 10, 11, or 12 months or longer when measured in vivo or in an in vitro assay.

As used herein, the term cleaved state refers to the condition of the activatable antibodies following modification of the CM by at least one protease. The term uncleaved state, as used herein, refers to the condition of the activatable antibodies in the absence of cleavage of the CM by a protease. As discussed above, the term "activatable antibodies" is used herein to refer to an activatable antibody in both its uncleaved (native) state, as well as in its cleaved state. It will be apparent to the ordinarily skilled artisan that in some embodiments a cleaved activatable antibody may lack an MM due to cleavage of the CM by protease, resulting in release of at least the MM (e.g., where the MM is not joined to the activatable antibodies by a covalent bond (e.g., a disulfide bond between cysteine residues).

By activatable or switchable is meant that the activatable antibody exhibits a first level of binding to a target when the activatable antibody is in a inhibited, masked or uncleaved state (i.e., a first conformation), and a second level of binding to the target in the uninhibited, unmasked and/or cleaved state (i.e., a second conformation), where the second level of target binding is greater than the first level of binding. In general, the access of target to the AB of the activatable antibody is greater in the presence of a cleaving agent capable of cleaving the CM, i.e., a protease, than in the absence of such a cleaving agent. Thus, when the activatable antibody is in the uncleaved state, the AB is inhibited from target binding and can be masked from target binding (i.e., the first conformation is such the AB cannot bind the target), and in the cleaved state the AB is not inhibited or is unmasked to target binding.

The CM and AB of the activatable antibodies are selected so that the AB represents a binding moiety for a given target, and the CM represents a substrate for a protease. In some embodiments, the protease is co-localized with the target at a treatment site or diagnostic site in a subject. As used herein, co-localized refers to being at the same site or relatively close nearby. In some embodiments, a protease cleaves a CM yielding an activated antibody that binds to a target located nearby the cleavage site. The activatable antibodies disclosed herein find particular use where, for example, a protease capable of cleaving a site in the CM, i.e., a protease, is present at relatively higher levels in or in close proximity to target-containing tissue of a treatment site or diagnostic site than in tissue of non-treatment sites (for example in healthy tissue). In some embodiments, a CM of the disclosure is also cleaved by one or more other proteases. In some embodiments, it is the one or more other proteases that is co-localized with the target and that is responsible for cleavage of the CM in vivo.

In some embodiments activatable antibodies provide for reduced toxicity and/or adverse side effects that could otherwise result from binding of the AB at non-treatment sites if the AB were not masked or otherwise inhibited from binding to the target.

In general, an activatable antibody can be designed by selecting an AB of interest and constructing the remainder of the activatable antibody so that, when conformationally constrained, the MM provides for masking of the AB or reduction of binding of the AB to its target. Structural design criteria can be to be taken into account to provide for this functional feature.

Activatable antibodies exhibiting a switchable phenotype of a desired dynamic range for target binding in an inhibited versus an uninhibited conformation are provided. Dynamic range generally refers to a ratio of (a) a maximum detected level of a parameter under a first set of conditions to (b) a minimum detected value of that parameter under a second set of conditions. For example, in the context of an activatable antibody, the dynamic range refers to the ratio of (a) a maximum detected level of target protein binding to an activatable antibody in the presence of at least one protease capable of cleaving the CM of the activatable antibodies to (b) a minimum detected level of target protein binding to an activatable antibody in the absence of the protease. The dynamic range of an activatable antibody can be calculated as the ratio of the dissociation constant of an activatable antibody cleaving agent (e.g., enzyme) treatment to the dissociation constant of the activatable antibodies cleaving agent treatment. The greater the dynamic range of an activatable antibody, the better the switchable phenotype of the activatable antibody. Activatable antibodies having relatively higher dynamic range values (e.g., greater than 1) exhibit more desirable switching phenotypes such that target protein binding by the activatable antibodies occurs to a greater extent (e.g., predominantly occurs) in the presence of a cleaving agent (e.g., enzyme) capable of cleaving the CM of the activatable antibodies than in the absence of a cleaving agent.

Activatable antibodies can be provided in a variety of structural configurations. Exemplary formulae for activatable antibodies are provided below. It is specifically contemplated that the N- to C-terminal order of the AB, MM and CM may be reversed within an activatable antibody. It is also specifically contemplated that the CM and MM may overlap in amino acid sequence, e.g., such that the CM is contained within the MM.

For example, activatable antibodies can be represented by the following formula (in order from an amino (N) terminal region to carboxyl (C) terminal region:

(MM)-(CM)-(AB)
(AB)-(CM)-(MM)

where MM is a masking moiety, CM is a cleavable moiety, and AB is an antibody or fragment thereof. It should be noted that although MM and CM are indicated as distinct components in the formulae above, in all exemplary embodiments (including formulae) disclosed herein it is contemplated that the amino acid sequences of the MM and the CM could overlap, e.g., such that the CM is completely or partially contained within the MM. In addition, the formulae above provide for additional amino acid sequences that may be positioned N-terminal or C-terminal to the activatable antibodies elements.

In certain embodiments, the MM is not a natural binding partner of the AB. In some embodiments, the MM contains no or substantially no homology to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% similar to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% identical to any natural binding partner of the AB. In some embodiments, the MM is no more than 50% identical to any natural binding partner of the AB. In some embodiments, the MM is no more than 25% identical to any natural binding partner of the AB. In some embodiments, the MM is no more than 20% identical to any natural binding partner of the AB.

In some embodiments, the MM is no more than 10% identical to any natural binding partner of the AB.

In many embodiments it may be desirable to insert one or more linkers, e.g., flexible linkers, into the activatable antibody construct so as to provide for flexibility at one or more of the MM-CM junction, the CM-AB junction, or both. For example, the AB, MM, and/or CM may not contain a sufficient number of residues (e.g., Gly, Ser, Asp, Asn, especially Gly and Ser, particularly Gly) to provide the desired flexibility. As such, the switchable phenotype of such activatable antibody constructs may benefit from introduction of one or more amino acids to provide for a flexible linker. In addition, as described below, where the activatable antibody is provided as a conformationally constrained construct, a flexible linker can be operably inserted to facilitate formation and maintenance of a cyclic structure in the uncleaved activatable antibody.

For example, in certain embodiments an activatable antibody comprises one of the following formulae (where the formula below represent an amino acid sequence in either N- to C-terminal direction or C- to N-terminal direction):

(MM)-L1-(CM)-(AB)
(MM)-(CM)-L2-(AB)
(MM)-L1-(CM)-L2-(AB) wherein MM, CM, and AB are as defined above; wherein L1 and L2 are each independently and optionally present or absent, are the same or different flexible linkers that include at least 1 flexible amino acid (e.g., Gly). In addition, the formulae above provide for additional amino acid sequences that may be positioned N-terminal or C-terminal to the activatable antibodies elements. Examples include, but are not limited to, targeting moieties (e.g., a ligand for a receptor of a cell present in a target tissue) and serum half-life extending moieties (e.g., polypeptides that bind serum proteins, such as immunoglobulin (e.g., IgG) or serum albumin (e.g., human serum albumin (HAS)).

The CM is specifically cleaved by at least one protease at a rate of about $0.001\text{-}1500 \times 10^4 M^{-1}S^{-1}$ or at least 0.001, 0.005, 0.01, 0.05, 0.1, 0.5, 1, 2.5, 5, 7.5, 10, 15, 20, 25, 50, 75, 100, 125, 150, 200, 250, 500, 750, 1000, 1250, or $1500 \times 10^4 \ M^{-1}S^{-1}$. In some embodiments, the CM is specifically cleaved at a rate of about $100,000 \ M^4 S^{-1}$. In some embodiments, the CM is specifically cleaved at a rate from about $1 \times 10E2$ to about $1 \times 10E6 \ M^{-1}S^{-1}$ (i.e., from about $1 \times 10^2$ to about $1 \times 10^6 M^{-1}S^{-1}$).

For specific cleavage by an enzyme, contact between the enzyme and CM is made. When the activatable antibody comprising an AB coupled to a MM and a CM is in the presence of target and sufficient enzyme activity, the CM can be cleaved. Sufficient enzyme activity can refer to the ability of the enzyme to make contact with the CM and effect cleavage. It can readily be envisioned that an enzyme may be in the vicinity of the CM but unable to cleave because of other cellular factors or protein modification of the enzyme.

Linkers suitable for use in compositions described herein are generally ones that provide flexibility of the modified AB or the activatable antibodies to facilitate the inhibition of the binding of the AB to the target. Such linkers are generally referred to as flexible linkers. Suitable linkers can be readily selected and can be of any of a suitable of different lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and may be 1, 2, 3, 4, 5, 6, 7, 8, 9, 10, 11, 12, 13, 14, 15, 16, 17, 18, 19, or 20 amino acids in length.

Exemplary flexible linkers include glycine polymers $(G)_n$, glycine-serine polymers (including, for example, $(GS)_n$, $(GSGGS)_n$ (SEQ ID NO: 191) and $(GGGS)_n$ (SEQ ID NO: 192), where n is an integer of at least one), glycine-alanine polymers, alanine-serine polymers, and other flexible linkers known in the art. Glycine and glycine-serine polymers are relatively unstructured, and therefore may be able to serve as a neutral tether between components. Glycine accesses significantly more phi-psi space than even alanine, and is much less restricted than residues with longer side chains (see Scheraga, Rev. Computational Chem. 11173-142 (1992)). Exemplary flexible linkers include, but are not limited to Gly-Gly-Ser-Gly (SEQ ID NO: 193), Gly-Gly-Ser-Gly-Gly (SEQ ID NO: 194), Gly-Ser-Gly-Ser-Gly (SEQ ID NO: 195), Gly-Ser-Gly-Gly-Gly (SEQ ID NO: 196), Gly-Gly-Gly-Ser-Gly (SEQ ID NO: 197), Gly-Ser-Ser-Ser-Gly (SEQ ID NO: 198), and the like. The ordinarily skilled artisan will recognize that design of an activatable antibodies can include linkers that are all or partially flexible, such that the linker can include a flexible linker as well as one or more portions that confer less flexible structure to provide for a desired activatable antibodies structure.

The disclosure also provides compositions and methods that include an activatable anti-PDL1 antibody that includes an antibody or antibody fragment (AB) that specifically binds PDL1, where the AB is coupled to a masking moiety (MM) that decreases the ability of the AB to bind its target. In some embodiments, the activatable anti-PDL1 antibody further includes a cleavable moiety (CM) that is a substrate for a protease. The compositions and methods provided herein enable the attachment of one or more agents to one or more cysteine residues in the AB without compromising the activity (e.g., the masking, activating or binding activity) of the activatable anti-PDL1 antibody. In some embodiments, the compositions and methods provided herein enable the attachment of one or more agents to one or more cysteine residues in the AB without reducing or otherwise disturbing one or more disulfide bonds within the MM. The compositions and methods provided herein produce an activatable anti-PDL1 antibody that is conjugated to one or more agents, e.g., any of a variety of therapeutic, diagnostic and/or prophylactic agents, for example, in some embodiments, without any of the agent(s) being conjugated to the MM of the activatable anti-PDL1 antibody. The compositions and methods provided herein produce conjugated activatable anti-PDL1 antibodies in which the MM retains the ability to effectively and efficiently mask the AB of the activatable antibody in an uncleaved state. The compositions and methods provided herein produce conjugated activatable anti-PDL1 antibodies in which the activatable antibody is still activated, i.e., cleaved, in the presence of a protease that can cleave the CM.

The activatable anti-PDL1 antibodies have at least one point of conjugation for an agent, but in the methods and compositions provided herein less than all possible points of conjugation are available for conjugation to an agent. In some embodiments, the one or more points of conjugation are sulfur atoms involved in disulfide bonds. In some embodiments, the one or more points of conjugation are sulfur atoms involved in interchain disulfide bonds. In some embodiments, the one or more points of conjugation are sulfur atoms involved in interchain sulfide bonds, but not sulfur atoms involved in intrachain disulfide bonds. In some embodiments, the one or more points of conjugation are sulfur atoms of cysteine or other amino acid residues containing a sulfur atom. Such residues may occur naturally in the antibody structure or may be incorporated into the antibody by site-directed mutagenesis, chemical conversion, or mis-incorporation of non-natural amino acids.

Also provided are methods of preparing a conjugate of an activatable anti-PDL1 antibody having one or more interchain disulfide bonds in the AB and one or more intrachain disulfide bonds in the MM, and a drug reactive with free thiols is provided. The method generally includes partially reducing interchain disulfide bonds in the activatable antibody with a reducing agent, such as, for example, TCEP; and conjugating the drug reactive with free thiols to the partially reduced activatable antibody. As used herein, the term partial reduction refers to situations where an activatable anti-PDL1 antibody is contacted with a reducing agent and less than all disulfide bonds, e.g., less than all possible sites of conjugation are reduced. In some embodiments, less than 99%, 98%, 97%, 96%, 95%, 90%, 85%, 80%, 75%, 70%, 65%, 60%, 55%, 50%, 45%, 40%, 35%, 30%, 25%, 20%, 15%, 10% or less than 5% of all possible sites of conjugation are reduced.

In yet other embodiments, a method of reducing and conjugating an agent, e.g., a drug, to an activatable anti-PDL1 antibody resulting in selectivity in the placement of the agent is provided. The method generally includes partially reducing the activatable anti-PDL1 antibody with a reducing agent such that any conjugation sites in the masking moiety or other non-AB portion of the activatable antibody are not reduced, and conjugating the agent to interchain thiols in the AB. The conjugation site(s) are selected so as to allow desired placement of an agent to allow conjugation to occur at a desired site. The reducing agent is, for example, TCEP. The reduction reaction conditions such as, for example, the ratio of reducing agent to activatable antibody, the length of incubation, the temperature during the incubation, the pH of the reducing reaction solution, etc., are determined by identifying the conditions that produce a conjugated activatable antibody in which the MM retains the ability to effectively and efficiently mask the AB of the activatable antibody in an uncleaved state. The ratio of reduction agent to activatable anti-PDL1 antibody will vary depending on the activatable antibody. In some embodiments, the ratio of reducing agent to activatable anti-PDL1 antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

In some embodiments, a method of reducing interchain disulfide bonds in the AB of an activatable anti-PDL1 antibody and conjugating an agent, e.g., a thiol-containing agent such as a drug, to the resulting interchain thiols to selectively locate agent(s) on the AB is provided. The method generally includes partially reducing the AB with a reducing agent to form at least two interchain thiols without forming all possible interchain thiols in the activatable antibody; and conjugating the agent to the interchain thiols of the partially reduced AB. For example, the AB of the activatable antibody is partially reduced for about 1 hour at about 37° C. at a desired ratio of reducing agent:activatable antibody. In some embodiments, the ratio of reducing agent to activatable antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

The thiol-containing reagent can be, for example, cysteine or N-acetyl cysteine. The reducing agent can be, for example, TCEP. In some embodiments, the reduced activatable antibody can be purified prior to conjugation, using for example, column chromatography, dialysis, or diafiltration. Alternatively, the reduced antibody is not purified after partial reduction and prior to conjugation.

The invention also provides partially reduced activatable anti-PDL1 antibodies in which at least one interchain disulfide bond in the activatable antibody has been reduced with a reducing agent without disturbing any intrachain disulfide bonds in the activatable antibody, wherein the activatable antibody includes an antibody or an antigen binding fragment thereof (AB) that specifically binds to PDL1, a masking moiety (MM) that inhibits the binding of the AB of the activatable antibody in an uncleaved state to the PDL1 target, and a cleavable moiety (CM) coupled to the AB, wherein the CM is a polypeptide that functions as a substrate for a protease. In some embodiments the MM is coupled to the AB via the CM. In some embodiments, one or more intrachain disulfide bond(s) of the activatable antibody is not disturbed by the reducing agent. In some embodiments, one or more intrachain disulfide bond(s) of the MM within the activatable antibody is not disturbed by the reducing agent. In some embodiments, the activatable antibody in the uncleaved state has the structural arrangement from N-terminus to C-terminus as follows: MM-CM-AB or AB-CM-MM. In some embodiments, reducing agent is TCEP.

The disclosure also provides partially reduced activatable antibodies in which at least one interchain disulfide bond in the activatable antibody has been reduced with a reducing agent without disturbing any intrachain disulfide bonds in the activatable antibody, wherein the activatable antibody includes an antibody or an antigen binding fragment thereof (AB) that specifically binds to the target, e.g., PDL1, a masking moiety (MM) that inhibits the binding of the AB of the activatable antibody in an uncleaved state to the target, and a cleavable moiety (CM) coupled to the AB, wherein the CM is a polypeptide that functions as a substrate for at least one protease. In some embodiments, the MM is coupled to the AB via the CM. In some embodiments, one or more intrachain disulfide bond(s) of the activatable antibody is not disturbed by the reducing agent. In some embodiments, one or more intrachain disulfide bond(s) of the MM within the activatable antibody is not disturbed by the reducing agent. In some embodiments, the activatable antibody in the uncleaved state has the structural arrangement from N-terminus to C-terminus as follows: MM-CM-AB or AB-CM-MM. In some embodiments, reducing agent is TCEP.

In some embodiments, the activatable antibodies described herein also include an agent conjugated to the activatable antibody. In some embodiments, the conjugated agent is a therapeutic agent, such as an anti-inflammatory and/or an antineoplastic agent. In such embodiments, the agent is conjugated to a carbohydrate moiety of the activatable antibody, for example, in some embodiments, where the carbohydrate moiety is located outside the antigen-binding region of the antibody or antigen-binding fragment in the activatable antibody. In some embodiments, the agent is conjugated to a sulfhydryl group of the antibody or antigen-binding fragment in the activatable antibody.

In some embodiments, the agent is a cytotoxic agent such as a toxin (e.g., an enzymatically active toxin of bacterial, fungal, plant, or animal origin, or fragments thereof), or a radioactive isotope (i.e., a radioconjugate).

In some embodiments, the agent is a detectable moiety such as, for example, a label or other marker. For example, the agent is or includes a radiolabeled amino acid, one or more biotinyl moieties that can be detected by marked avidin (e.g., streptavidin containing a fluorescent marker or enzymatic activity that can be detected by optical or calorimetric methods), one or more radioisotopes or radionuclides, one or more fluorescent labels, one or more enzymatic labels, and/or one or more chemiluminescent agents. In some embodiments, detectable moieties are attached by spacer molecules.

The disclosure also pertains to immunoconjugates comprising an antibody conjugated to a cytotoxic agent such as a toxin (e.g., an enzymatically active toxin of bacterial, fungal, plant, or animal origin, or fragments thereof), or a radioactive isotope (i.e., a radioconjugate). Suitable cytotoxic agents include, for example, dolastatins and derivatives thereof (e.g. auristatin E, AFP, MMAF, MMAE, MMAD, DMAF, DMAE). For example, the agent is monomethyl auristatin E (MMAE) or monomethyl auristatin D (MMAD). In some embodiments, the agent is an agent selected from the group listed in Table 11. In some embodiments, the agent is a dolastatin. In some embodiments, the agent is an auristatin or derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid or maytansinoid derivative. In some embodiments, the agent is DM1 or DM4. In some embodiments, the agent is a duocarmycin or derivative thereof. In some embodiments, the agent is a calicheamicin or derivative thereof. In some embodiments, the agent is a pyrrolobenzodiazepine. In some embodiments, the agent is a pyrrolobenzodiazepine dimer.

In some embodiments, the agent is linked to the AB using a maleimide caproyl-valine-citrulline linker or a maleimide PEG-valine-citrulline linker. In some embodiments, the agent is linked to the AB using a maleimide caproyl-valine-citrulline linker. In some embodiments, the agent is linked to the AB using a maleimide PEG-valine-citrulline linker In some embodiments, the agent is monomethyl auristatin D (MMAD) linked to the AB using a maleimide PEG-valine-citrulline-para-aminobenzyloxycarbonyl linker, and this linker payload construct is referred to herein as "vc-MMAD." In some embodiments, the agent is monomethyl auristatin E (MMAE) linked to the AB using a maleimide PEG-valine-citrulline-para-aminobenzyloxycarbonyl linker, and this linker payload construct is referred to herein as "vc-MMAE." The structures of vc-MMAD and vc-MMAE are shown below:

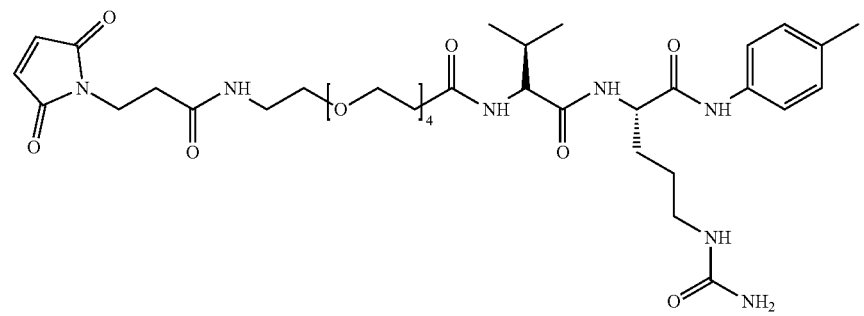

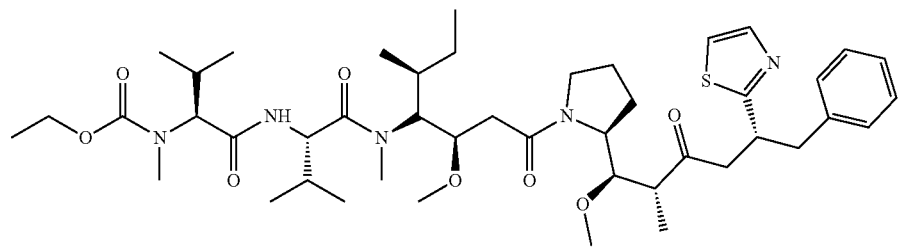

-continued

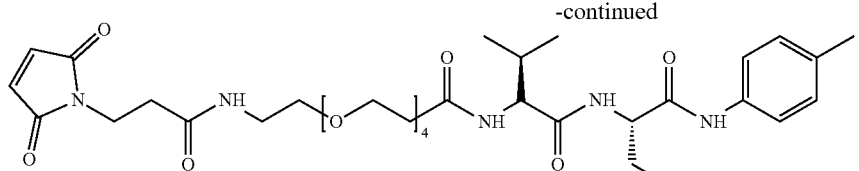
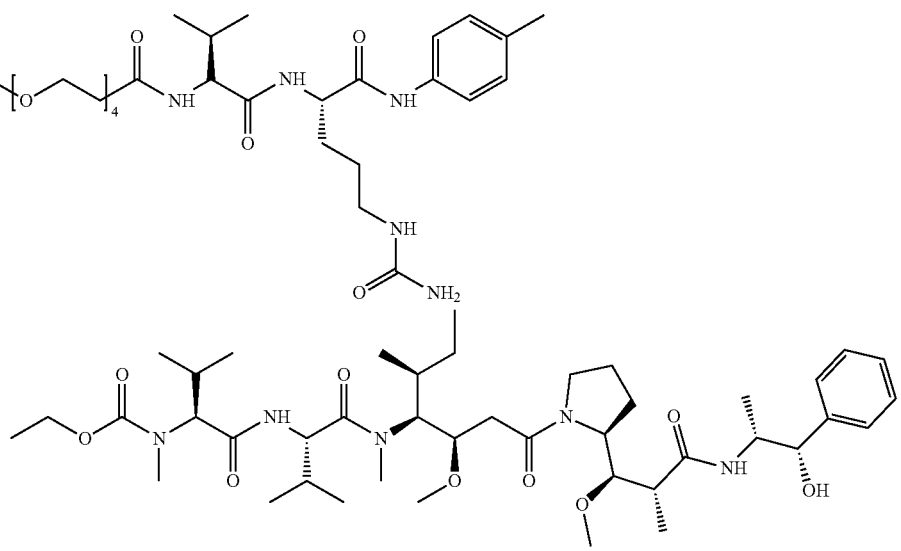

The disclosure also provides conjugated activatable antibodies that include an activatable antibody linked to monomethyl auristatin D (MMAD) payload, wherein the activatable antibody includes an antibody or an antigen binding fragment thereof (AB) that specifically binds to a target, a masking moiety (MM) that inhibits the binding of the AB of the activatable antibody in an uncleaved state to the target, and cleavable moiety (CM) coupled to the AB, and the CM is a polypeptide that functions as a substrate for at least one MMP protease.

In some embodiments, the MMAD-conjugated activatable antibody can be conjugated using any of several methods for attaching agents to ABs: (a) attachment to the carbohydrate moieties of the AB, or (b) attachment to sulfhydryl groups of the AB, or (c) attachment to amino groups of the AB, or (d) attachment to carboxylate groups of the AB.

In some embodiments, the MMAD payload is conjugated to the AB via a linker. In some embodiments, the MMAD payload is conjugated to a cysteine in the AB via a linker. In some embodiments, the MMAD payload is conjugated to a lysine in the AB via a linker. In some embodiments, the MMAD payload is conjugated to another residue of the AB via a linker, such as those residues disclosed herein. In some embodiments, the linker is a thiol-containing linker. In some embodiments, the linker is a cleavable linker. In some embodiments, the linker is a non-cleavable linker. In some embodiments, the linker is selected from the group consisting of the linkers shown in Tables 13 and 14. In some embodiments, the activatable antibody and the MMAD payload are linked via a maleimide caproyl-valine-citrulline linker. In some embodiments, the activatable antibody and the MMAD payload are linked via a maleimide PEG-valine-citrulline linker. In some embodiments, the activatable antibody and the MMAD payload are linked via a maleimide caproyl-valine-citrulline-para-aminobenzyloxycarbonyl linker. In some embodiments, the activatable antibody and the MMAD payload are linked via a maleimide PEG-valine-citrulline-para-aminobenzyloxycarbonyl linker. In some embodiments, the MMAD payload is conjugated to the AB using the partial reduction and conjugation technology disclosed herein.

In some embodiments, the polyethylene glycol (PEG) component of a linker of the present disclosure is formed from 2 ethylene glycol monomers, 3 ethylene glycol monomers, 4 ethylene glycol monomers, 5 ethylene glycol monomers, 6 ethylene glycol monomers, 7 ethylene glycol monomers, 8 ethylene glycol monomers, 9 ethylene glycol monomers, or at least 10 ethylene glycol monomers. In some embodiments of the present disclosure, the PEG component is a branched polymer. In some embodiments of the present disclosure, the PEG component is an unbranched polymer. In some embodiments, the PEG polymer component is functionalized with an amino group or derivative thereof, a carboxyl group or derivative thereof, or both an amino group or derivative thereof and a carboxyl group or derivative thereof.

In some embodiments, the PEG component of a linker of the present disclosure is an amino-tetra-ethylene glycol-carboxyl group or derivative thereof. In some embodiments, the PEG component of a linker of the present disclosure is an amino-tri-ethylene glycol-carboxyl group or derivative thereof. In some embodiments, the PEG component of a linker of the present disclosure is an amino-di-ethylene glycol-carboxyl group or derivative thereof. In some embodiments, an amino derivative is the formation of an amide bond between the amino group and a carboxyl group to which it is conjugated. In some embodiments, a carboxyl derivative is the formation of an amide bond between the carboxyl group and an amino group to which it is conjugated. In some embodiments, a carboxyl derivative is the formation of an ester bond between the carboxyl group and an hydroxyl group to which it is conjugated.

Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science 238: 1098 (1987). Carbon-14-labeled 1-isothiocyanatobenzyl-3-methyldiethylene tri-aminepentaacetic acid (MX-DTPA) is an exemplary chelating agent for conjugation of radionucleotide to the antibody. (See WO94/11026).

Table 11 lists some of the exemplary pharmaceutical agents that may be employed in the herein described disclosure but in no way is meant to be an exhaustive list.

TABLE 11

Exemplary Pharmaceutical Agents for Conjugation

CYTOTOXIC AGENTS

| | |
|---|---|
| Auristatins | Turbostatin |
| Auristatin E | Phenstatins |
| Monomethyl auristatin D (MMAD) | Hydroxyphenstatin |
| Monomethyl auristatin E (MMAE) | Spongistatin 5 |
| Desmethyl auristatin E (DMAE) | Spongistatin 7 |
| Auristatin F | Halistatin 1 |
| Monomethyl auristatin F (MMAF) | Halistatin 2 |
| Desmethyl auristatin F (DMAF) | Halistatin 3 |
| Auristatin derivatives, e.g., amides thereof | Modified Bryostatins |
| Auristatin tyramine | Halocomstatins |
| Auristatin quinoline | Pyrrolobenzimidazoles (PBI) |
| Dolastatins | Cibrostatin6 |
| Dolastatin derivatives | Doxaliform |
| Dolastatin 16 DmJ | Anthracyclins analogues |
| Dolastatin 16 Dpv | |
| Maytansinoids, e.g. DM-1; DM4 | |
| Maytansinoid derivatives | Cemadotin analogue (CemCH2-SH) |
| Duocarmycin | Pseudomonas toxin A (PE38) variant |
| Duocarmycin derivatives | Pseudomonas toxin A (ZZ-PE38) variant |
| Alpha-amanitin | ZJ-101 |
| Anthracyclines | OSW-1 |
| Doxorubicin | 4-Nitrobenzyloxycarbonyl Derivatibes of O60BBenzylguanine |
| Daunorubicin | Topoisomerase inhibitors |
| Bryostatins | Hemiasterlin |
| Camptothecin | Cephalotaxine |
| Camptothecin derivatives | Homoharringtonine |
| 7-substituted Camptothecin | Pyrrolobenzodiazepine dimers (PBDs) |
| 10, 11-Difluoromethylenedioxy-camptothecin | Pyrrolobenzodiazepenes |
| Combretastatins | Functionalized pyrrolobenzodiazepenes |
| Debromoaplysiatoxin | Functionalized pyrrolobenzodiazepene dimers |
| Kahalalide-F | Calicheamicins |
| Discodermolide | Podophyllotoxins |
| Ecteinascidins | Taxanes |
| | Vinca alkaloids |

TABLE 11-continued

Exemplary Pharmaceutical Agents for Conjugation

| ANTIVIRALS | CONJUGATABLE DETECTION REAGENTS |
|---|---|
| Acyclovir | |
| Vira A | Fluorescein and derivatives thereof |
| Symmetrel | Fluorescein isothiocyanate (FITC) |
| ANTIFUNGALS | RADIOPHARMACEUTICALS |
| Nystatin | $^{125}I$ |
| | $^{131}I$ |
| ADDITIONAL ANTI-NEO-PLASTICS | $^{89}Zr$ |
| Adriamycin | $^{111}In$ |
| Cerubidine | $^{123}I$ |
| Bleomycin | $^{131}I$ |
| Alkeran | $^{99}mTc$ |
| Velban | $^{201}Tl$ |
| Oncovin | $^{133}Xe$ |
| Fluorouracil | $^{11}C$ |
| Methotrexate | $^{62}Cu$ |
| Thiotepa | $^{18}F$ |
| Disantrene | $^{68}Ga$ |
| Novantrone | $^{13}N$ |
| Thioguanine | $^{15}O$ |
| Procarabizine | $^{38}K$ |
| Cytarabine | $^{82}Rb$ |
| | $^{99}mTc$ (Technetium) |
| ANTI-BACTERIALS | |
| Aminoglycosides | HEAVY METALS |
| Streptomycin | Barium |
| Neomycin | Gold |
| Kanamycin | Platinum |
| Amikacin | |
| Gentamicin | ANTI-MYCOPLASMALS |
| Tobramycin | Tylosine |
| Streptomycin B | Spectinomycin |
| Spectinomycin | |
| Ampicillin | |
| Sulfanilamide | |
| Polymyxin | |
| Chloramphenicol | |

Those of ordinary skill in the art will recognize that a large variety of possible moieties can be coupled to the resultant antibodies of the disclosure. (See, for example, "Conjugate Vaccines", Contributions to Microbiology and Immunology, J. M. Cruse and R. E. Lewis, Jr (eds), Carger Press, New York, (1989), the entire contents of which are incorporated herein by reference).

Coupling may be accomplished by any chemical reaction that will bind the two molecules so long as the antibody and the other moiety retain their respective activities. This linkage can include many chemical mechanisms, for instance covalent binding, affinity binding, intercalation, coordinate binding and complexation. In some embodiments, the binding is, however, covalent binding. Covalent binding can be achieved either by direct condensation of existing side chains or by the incorporation of external bridging molecules. Many bivalent or polyvalent linking agents are useful in coupling protein molecules, such as the antibodies of the present disclosure, to other molecules. For example, representative coupling agents can include organic compounds such as thioesters, carbodiimides, succinimide esters, diisocyanates, glutaraldehyde, diazobenzenes and hexamethylene diamines. This listing is not intended to be exhaustive of the various classes of coupling agents known in the art but, rather, is exemplary of the more common coupling agents. (See Killen and Lindstrom, Jour. Immun.

133:1335-2549 (1984); Jansen et al., Immunological Reviews 62:185-216 (1982); and Vitetta et al., Science 238:1098 (1987).

In some embodiments, in addition to the compositions and methods provided herein, the conjugated activatable antibody can also be modified for site-specific conjugation through modified amino acid sequences inserted or otherwise included in the activatable antibody sequence. These modified amino acid sequences are designed to allow for controlled placement and/or dosage of the conjugated agent within a conjugated activatable antibody. For example, the activatable antibody can be engineered to include cysteine substitutions at positions on light and heavy chains that provide reactive thiol groups and do not negatively impact protein folding and assembly, nor alter antigen binding. In some embodiments, the activatable antibody can be engineered to include or otherwise introduce one or more non-natural amino acid residues within the activatable antibody to provide suitable sites for conjugation. In some embodiments, the activatable antibody can be engineered to include or otherwise introduce enzymatically activatable peptide sequences within the activatable antibody sequence.

Suitable linkers are described in the literature. (See, for example, Ramakrishnan, S. et al., Cancer Res. 44:201-208 (1984) describing use of MBS (M-maleimidobenzoyl-N-hydroxysuccinimide ester). See also, U.S. Pat. No. 5,030,719, describing use of halogenated acetyl hydrazide derivative coupled to an antibody by way of an oligopeptide linker. In some embodiments, suitable linkers include: (i) EDC (1-ethyl-3-(3-dimethylamino-propyl) carbodiimide hydrochloride; (ii) SMPT (4-succinimidyloxycarbonyl-alpha-methyl-alpha-(2-pridyl-dithio)-toluene (Pierce Chem. Co., Cat. (21558G); (iii) SPDP (succinimidyl-6 [3-(2-pyridyldithio) propionamido]hexanoate (Pierce Chem. Co., Cat #21651G); (iv) Sulfo-LC-SPDP (sulfosuccinimidyl 6 [3-(2-pyridyldithio)-propianamide] hexanoate (Pierce Chem. Co. Cat. #2165-G); and (v) sulfo-NHS (N-hydroxysulfo-succinimide: Pierce Chem. Co., Cat. #24510) conjugated to EDC. Additional linkers include, but are not limited to, SMCC, sulfo-SMCC, SPDB, or sulfo-SPDB.

The linkers described above contain components that have different attributes, thus leading to conjugates with differing physio-chemical properties. For example, sulfo-NHS esters of alkyl carboxylates are more stable than sulfo-NHS esters of aromatic carboxylates. NETS-ester containing linkers are less soluble than sulfo-NHS esters. Further, the linker SMPT contains a sterically hindered disulfide bond, and can form conjugates with increased stability. Disulfide linkages, are in general, less stable than other linkages because the disulfide linkage is cleaved in vitro, resulting in less conjugate available. Sulfo-NHS, in particular, can enhance the stability of carbodimide couplings. Carbodimide couplings (such as EDC) when used in conjunction with sulfo-NHS, forms esters that are more resistant to hydrolysis than the carbodimide coupling reaction alone.

In some embodiments, the linkers are cleavable. In some embodiments, the linkers are non-cleavable. In some embodiments, two or more linkers are present. The two or more linkers are all the same, i.e., cleavable or non-cleavable, or the two or more linkers are different, i.e., at least one cleavable and at least one non-cleavable.

The present disclosure utilizes several methods for attaching agents to ABs: (a) attachment to the carbohydrate moieties of the AB, or (b) attachment to sulfhydryl groups of the AB, or (c) attachment to amino groups of the AB, or (d) attachment to carboxylate groups of the AB. According to the disclosure, ABs may be covalently attached to an agent through an intermediate linker having at least two reactive groups, one to react with AB and one to react with the agent. The linker, which may include any compatible organic compound, can be chosen such that the reaction with AB (or agent) does not adversely affect AB reactivity and selectivity. Furthermore, the attachment of linker to agent might not destroy the activity of the agent. Suitable linkers for reaction with oxidized antibodies or oxidized antibody fragments include those containing an amine selected from the group consisting of primary amine, secondary amine, hydrazine, hydrazide, hydroxylamine, phenylhydrazine, semicarbazide and thiosemicarbazide groups. Such reactive functional groups may exist as part of the structure of the linker, or may be introduced by suitable chemical modification of linkers not containing such groups.

According to the present disclosure, suitable linkers for attachment to reduced ABs include those having certain reactive groups capable of reaction with a sulfhydryl group of a reduced antibody or fragment. Such reactive groups include, but are not limited to: reactive haloalkyl groups (including, for example, haloacetyl groups), p-mercuribenzoate groups and groups capable of Michael-type addition reactions (including, for example, maleimides and groups of the type described by Mitra and Lawton, 1979, J. Amer. Chem. Soc. 101: 3097-3110).

According to the present disclosure, suitable linkers for attachment to neither oxidized nor reduced Abs include those having certain functional groups capable of reaction with the primary amino groups present in unmodified lysine residues in the Ab. Such reactive groups include, but are not limited to, NHS carboxylic or carbonic esters, sulfo-NHS carboxylic or carbonic esters, 4-nitrophenyl carboxylic or carbonic esters, pentafluorophenyl carboxylic or carbonic esters, acyl imidazoles, isocyanates, and isothiocyanates.

According to the present disclosure, suitable linkers for attachment to neither oxidized nor reduced Abs include those having certain functional groups capable of reaction with the carboxylic acid groups present in aspartate or glutamate residues in the Ab, which have been activated with suitable reagents. Suitable activating reagents include EDC, with or without added NHS or sulfo-NHS, and other dehydrating agents utilized for carboxamide formation. In these instances, the functional groups present in the suitable linkers would include primary and secondary amines, hydrazines, hydroxylamines, and hydrazides.

The agent may be attached to the linker before or after the linker is attached to the AB. In certain applications it may be desirable to first produce an AB-linker intermediate in which the linker is free of an associated agent. Depending upon the particular application, a specific agent may then be covalently attached to the linker. In some embodiments, the AB is first attached to the MM, CM and associated linkers and then attached to the linker for conjugation purposes.

Branched Linkers: In specific embodiments, branched linkers that have multiple sites for attachment of agents are utilized. For multiple site linkers, a single covalent attachment to an AB would result in an AB-linker intermediate capable of binding an agent at a number of sites. The sites may be aldehyde or sulfhydryl groups or any chemical site to which agents can be attached.

In some embodiments, higher specific activity (or higher ratio of agents to AB) can be achieved by attachment of a single site linker at a plurality of sites on the AB. This plurality of sites may be introduced into the AB by either of two methods. First, one may generate multiple aldehyde groups and/or sulfhydryl groups in the same AB. Second, one may attach to an aldehyde or sulfhydryl of the AB a "branched linker" having multiple functional sites for subsequent attachment to linkers. The functional sites of the branched linker or multiple site linker may be aldehyde or sulfhydryl groups, or may be any chemical site to which linkers may be attached. Still higher specific activities may be obtained by combining these two approaches, that is, attaching multiple site linkers at several sites on the AB.

Cleavable Linkers: Peptide linkers that are susceptible to cleavage by enzymes of the complement system, such as but not limited to u-plasminogen activator, tissue plasminogen activator, trypsin, plasmin, or another enzyme having proteolytic activity may be used in one embodiment of the present disclosure. According to one method of the present disclosure, an agent is attached via a linker susceptible to cleavage by complement. The antibody is selected from a class that can activate complement. The antibody-agent conjugate, thus, activates the complement cascade and releases the agent at the target site. According to another method of the present disclosure, an agent is attached via a linker susceptible to cleavage by enzymes having a proteolytic activity such as a u-plasminogen activator, a tissue plasminogen activator, plasmin, or trypsin. These cleavable linkers are useful in conjugated activatable antibodies that include an extracellular toxin, e.g., by way of non-limiting example, any of the extracellular toxins shown in Table 11.

Non-limiting examples of cleavable linker sequences are provided in Table 13.

TABLE 13

Exemplary Linker Sequences for Conjugation

| Types of Cleavable Sequences | Amino Acid Sequence |
| --- | --- |
| Plasmin cleavable sequences | |
| Pro-urokinase | PRFKIIGG (SEQ ID NO: 396) |
|  | PRFRIIGG (SEQ ID NO: 397) |
| TGFβ | SSRHRRALD (SEQ ID NO: 398) |
| Plasminogen | RKSSIIRMRDVVL (SEQ ID NO: 399) |
| Staphylokinase | SSSFDKGKYKKGDDA (SEQ ID NO: 400) |
|  | SSSFDKGKYKRGDDA (SEQ ID NO: 401) |
| Factor Xa cleavable sequences | IEGR (SEQ ID NO: 402) |
|  | IDGR (SEQ ID NO: 403) |
|  | GGSIDGR (SEQ ID NO: 404) |
| MMP cleavable sequences | |
| Gelatinase A | PLGLWA (SEQ ID NO: 405) |
| Collagenase cleavable sequences | |
| Calf skin collagen (α1(I) chain) | GPQGIAGQ (SEQ ID NO: 406) |
| Calf skin collagen (α2(I) chain) | GPQGLLGA (SEQ ID NO: 407) |
| Bovine cartilage collagen (α1(II) chain) | GIAGQ (SEQ ID NO: 408) |
| Human liver collagen (α1(III) chain) | GPLGIAGI (SEQ ID NO: 409) |
| Human α₂M | GPEGLRVG (SEQ ID NO: 410) |
| Human PZP | YGAGLGVV (SEQ ID NO: 411) |
|  | AGLGVVER (SEQ ID NO: 412) |
|  | AGLGISST (SEQ ID NO: 413) |
| Rat α₁M | EPQALAMS (SEQ ID NO: 414) |
|  | QALAMSAI (SEQ ID NO: 415) |
| Rat α₂M | AAYHLVSQ (SEQ ID NO: 416) |
|  | MDAFLESS (SEQ ID NO: 417) |
| Rat α₁I₃(2J) | ESLPVVAV (SEQ ID NO: 418) |
| Rat α₁I₃(27J) | SAPAVESE (SEQ ID NO: 419) |
| Human fibroblast collagenase (autolytic cleavages) | DVAQFVLT (SEQ ID NO: 420) |
|  | VAQFVLTE (SEQ ID NO: 421) |
|  | AQFVLTEG (SEQ ID NO: 422) |
|  | PVQPIGPQ (SEQ ID NO: 423) |

In addition, agents may be attached via disulfide bonds (for example, the disulfide bonds on a cysteine molecule) to the AB. Since many tumors naturally release high levels of glutathione (a reducing agent) this can reduce the disulfide bonds with subsequent release of the agent at the site of delivery. In some embodiments, the reducing agent that would modify a CM would also modify the linker of the conjugated activatable antibody.

Spacers and Cleavable Elements: In some embodiments, it may be necessary to construct the linker in such a way as to optimize the spacing between the agent and the AB of the activatable antibody. This may be accomplished by use of a linker of the general structure:

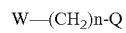

W—(CH₂)n-Q wherein
W is either —NH—CH₂— or —CH₂—;
Q is an amino acid, peptide; and
n is an integer from 0 to 20.

In some embodiments, the linker may comprise a spacer element and a cleavable element. The spacer element serves to position the cleavable element away from the core of the AB such that the cleavable element is more accessible to the enzyme responsible for cleavage. Certain of the branched linkers described above may serve as spacer elements.

Throughout this discussion, it should be understood that the attachment of linker to agent (or of spacer element to cleavable element, or cleavable element to agent) need not be particular mode of attachment or reaction. Any reaction providing a product of suitable stability and biological compatibility is acceptable.

Serum Complement and Selection of Linkers:

According to one method of the present disclosure, when release of an agent is desired, an AB that is an antibody of a class that can activate complement is used. The resulting conjugate retains both the ability to bind antigen and activate the complement cascade. Thus, according to this embodiment of the present disclosure, an agent is joined to one end of the cleavable linker or cleavable element and the other end of the linker group is attached to a specific site on the AB. For example, if the agent has an hydroxy group or an amino group, it may be attached to the carboxy terminus of a peptide, amino acid or other suitably chosen linker via an ester or amide bond, respectively. For example, such agents may be attached to the linker peptide via a carbodimide reaction. If the agent contains functional groups that would interfere with attachment to the linker, these interfering functional groups can be blocked before attachment and deblocked once the product conjugate or intermediate is made. The opposite or amino terminus of the linker is then used either directly or after further modification for binding to an AB that is capable of activating complement.

Linkers (or spacer elements of linkers) may be of any desired length, one end of which can be covalently attached to specific sites on the AB of the activatable antibody. The other end of the linker or spacer element may be attached to an amino acid or peptide linker.

Thus when these conjugates bind to antigen in the presence of complement the amide or ester bond that attaches the agent to the linker will be cleaved, resulting in release of the agent in its active form. These conjugates, when administered to a subject, will accomplish delivery and release of the agent at the target site, and are particularly effective for the in vivo delivery of pharmaceutical agents, antibiotics, antimetabolites, antiproliferative agents and the like as presented in but not limited to those in Table 11.

Linkers for Release without Complement Activation:

In yet another application of targeted delivery, release of the agent without complement activation is desired since activation of the complement cascade will ultimately lyse the target cell. Hence, this approach is useful when delivery and release of the agent should be accomplished without killing the target cell. Such is the goal when delivery of cell mediators such as hormones, enzymes, corticosteroids, neurotransmitters, genes or enzymes to target cells is desired. These conjugates may be prepared by attaching the agent to an AB that is not capable of activating complement via a linker that is mildly susceptible to cleavage by serum proteases. When this conjugate is administered to an individual, antigen-antibody complexes will form quickly whereas cleavage of the agent will occur slowly, thus resulting in release of the compound at the target site.

Biochemical Cross Linkers:

In some embodiments, the activatable antibody may be conjugated to one or more therapeutic agents using certain biochemical cross-linkers. Cross-linking reagents form molecular bridges that tie together functional groups of two different molecules. To link two different proteins in a step-wise manner, hetero-bifunctional cross-linkers can be used that eliminate unwanted homopolymer formation.

Peptidyl linkers cleavable by lysosomal proteases are also useful, for example, Val-Cit, Val-Ala or other dipeptides. In addition, acid-labile linkers cleavable in the low-pH environment of the lysosome may be used, for example: bis-sialyl ether. Other suitable linkers include cathepsin-labile substrates, particularly those that show optimal function at an acidic pH.

Exemplary hetero-bifunctional cross-linkers are referenced in Table 14.

TABLE 14

Exemplary Hetero-Bifunctional Cross Linkers
HETERO-BIFUNCTIONAL CROSS-LINKERS

| Linker | Reactive Toward | Advantages and Applications | Spacer Arm Length after cross-linking (Angstroms) |
|---|---|---|---|
| SMPT | Primary amines Sulfhydryls | Greater stability | 11.2 Å |
| SPDP | Primary amines Sulfhydryls | Thiolation Cleavable cross-linking | 6.8 Å |
| LC-SPDP | Primary amines Sulfhydryls | Extended spacer arm | 15.6 Å |
| Sulfo-LS-SPDP | Primary amines Sulfhydryls | Extender spacer arm Water-soluble | 15.6 Å |
| SMCC | Primary amines Sulfhydryls | Stable maleimide reactive group Enzyme-antibody conjugation Hapten-carrier protein conjugation | 11.6 Å |
| Sulfo-SMCC | Primary amines Sulhydryls | Stable maleimide reactive group Water-soluble Enzyme-antibody conjugation | 11.6 Å |
| MBS | Primary amines Sulfhydryls | Enzyme-antibody conjugation Hapten-carrier protein conjugation | 9.9 Å |
| Sulfo-MBS | Primary amines Sulfhydryls | Water-soluble | 9.9 Å |
| SIAB | Primary amines Sulfhydryls | Enzyme-antibody conjugation | 10.6 Å |
| Sulfo-SIAB | Primary amines Sulfhydryls | Water-soluble | 10.6 Å |
| SMPB | Primary amines Sulfhydryls | Extended spacer arm Enzyme-antibody conjugation | 14.5 Å |

TABLE 14-continued

Exemplary Hetero-Bifunctional Cross Linkers
HETERO-BIFUNCTIONAL CROSS-LINKERS

| Linker | Reactive Toward | Advantages and Applications | Spacer Arm Length after cross-linking (Angstroms) |
|---|---|---|---|
| Sulfo-SMPB | Primary amines Sulfhydryls | Extended spacer arm Water-soluble | 14.5 Å |
| EDE/Sulfo-NHS | Primary amines Carboxyl groups | Hapten-Carrier conjugation | 0 |
| ABH | Carbohydrates Nonselective | Reacts with sugar groups | 11.9 Å |

Non-Cleavable Linkers or Direct Attachment:

In some embodiments of the disclosure, the conjugate may be designed so that the agent is delivered to the target but not released. This may be accomplished by attaching an agent to an AB either directly or via a non-cleavable linker.

These non-cleavable linkers may include amino acids, peptides, D-amino acids or other organic compounds that may be modified to include functional groups that can subsequently be utilized in attachment to ABs by the methods described herein. A general formula for such an organic linker could be $$W—(CH_2)n-Q$$

wherein
W is either $—NH—CH_2—$ or $—CH_2—$;
Q is an amino acid, peptide; and
n is an integer from 0 to 20.

Non-Cleavable Conjugates:

In some embodiments, a compound may be attached to ABs that do not activate complement. When using ABs that are incapable of complement activation, this attachment may be accomplished using linkers that are susceptible to cleavage by activated complement or using linkers that are not susceptible to cleavage by activated complement.

The antibodies disclosed herein can also be formulated as immunoliposomes. Liposomes containing the antibody are prepared by methods known in the art, such as described in Epstein et al., Proc. Natl. Acad. Sci. USA, 82: 3688 (1985); Hwang et al., Proc. Natl Acad. Sci. USA, 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present disclosure can be conjugated to the liposomes as described in Martin et al., J. Biol. Chem., 257: 286-288 (1982) via a disulfide-interchange reaction.

Definitions

Unless otherwise defined, scientific and technical terms used in connection with the present disclosure shall have the meanings that are commonly understood by those of ordinary skill in the art. The term "a" entity or "an" entity refers to one or more of that entity. For example, a compound refers to one or more compounds. As such, the terms "a", "an", "one or more" and "at least one" can be used interchangeably. Further, unless otherwise required by context, singular terms shall include pluralities and plural terms shall include the singular. Generally, nomenclatures utilized in connection with, and techniques of, cell and tissue culture, molecular biology, and protein and oligo- or polynucleotide chemistry and hybridization described herein are those well-known and commonly used in the art. Standard techniques are used for recombinant DNA, oligonucleotide synthesis, and tissue culture and transformation (e.g., electroporation, lipofection). Enzymatic reactions and purification techniques are performed according to manufacturer's specifications or as commonly accomplished in the art or as described herein. The foregoing techniques and procedures are generally performed according to conventional methods well known in the art and as described in various general and more specific references that are cited and discussed throughout the present specification. See e.g., Sambrook et al. Molecular Cloning: A Laboratory Manual (2d ed., Cold Spring Harbor Laboratory Press, Cold Spring Harbor, N.Y. (1989)). The nomenclatures utilized in connection with, and the laboratory procedures and techniques of, analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, and delivery, and treatment of patients.

As utilized in accordance with the present disclosure, the following terms, unless otherwise indicated, shall be understood to have the following meanings:

As used herein, the term "antibody" refers to immunoglobulin molecules and immunologically active portions of immunoglobulin (Ig) molecules, i.e., molecules that contain an antigen binding site that specifically binds (immunoreacts with) an antigen. By "specifically bind" or "immunoreacts with" or "immunospecifically bind" is meant that the antibody reacts with one or more antigenic determinants of the desired antigen and does not react with other polypeptides or binds at much lower affinity ($K_d$>10'). Antibodies include, but are not limited to, polyclonal, monoclonal, chimeric, domain antibody, single chain, Fab, and F(ab')$_2$ fragments, scFvs, and an Fab expression library.

The basic antibody structural unit is known to comprise a tetramer. Each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. In general, antibody molecules obtained from humans relate to any of the classes IgG, IgM, IgA, IgE and IgD, which differ from one another by the nature of the heavy chain present in the molecule. Certain classes have subclasses as well, such as IgG$_1$, IgG$_2$, and others. Furthermore, in humans, the light chain may be a kappa chain or a lambda chain.

The term "monoclonal antibody" (mAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs contain an antigen binding site capable of immunoreacting with a particular epitope of the antigen characterized by a unique binding affinity for it.

The term "antigen-binding site" or "binding portion" refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains, referred to as "hypervariable regions," are interposed between more conserved flanking stretches known as "framework regions," or "FRs". Thus, the term "FR" refers to amino acid sequences that are naturally found between, and adjacent to, hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs." The assignment of amino acids to each domain is in accordance with the definitions of Kabat Sequences of Proteins of Immunological Interest (National Institutes of Health, Bethesda, Md. (1987 and 1991)), or Chothia & Lesk J. Mol. Biol. 196:901-917 (1987), Chothia et al. Nature 342:878-883 (1989).

As used herein, the term "epitope" includes any protein determinant capable of specific binding to an immunoglobulin, an scFv, or a T-cell receptor. The term "epitope" includes any protein determinant capable of specific binding to an immunoglobulin or T-cell receptor. Epitopic determinants usually consist of chemically active surface groupings of molecules such as amino acids or sugar side chains and usually have specific three dimensional structural characteristics, as well as specific charge characteristics. For example, antibodies may be raised against N-terminal or C-terminal peptides of a polypeptide. An antibody is said to specifically bind an antigen when the dissociation constant is ≤1 µM; in some embodiments, ≤100 nM and in some embodiments, ≤10 nM.

As used herein, the terms "specific binding," "immunological binding," and "immunological binding properties" refer to the non-covalent interactions of the type which occur between an immunoglobulin molecule and an antigen for which the immunoglobulin is specific. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and geometric parameters that equally influence the rate in both directions. Thus, both the "on rate constant" ($K_{on}$) and the "off rate constant" ($K_{off}$) can be determined by calculation of the concentrations and the actual rates of association and dissociation. (See Nature 361:186-87 (1993)). The ratio of $K_{off}/K_{on}$ enables the cancellation of all parameters not related to affinity, and is equal to the dissociation constant $K_d$. (See, generally, Davies et al. (1990) Annual Rev Biochem 59:439-473). An antibody of the present disclosure is said to specifically bind to the target, when the binding constant ($K_d$) is µM, in some embodiments 100 nM, in some embodiments 10 nM, and in some embodiments ≤100 pM to about 1 pM, as measured by assays such as radioligand binding assays or similar assays known to those skilled in the art.

The term "isolated polynucleotide" as used herein shall mean a polynucleotide of genomic, cDNA, or synthetic origin or some combination thereof, which by virtue of its origin the "isolated polynucleotide" (1) is not associated with all or a portion of a polynucleotide in which the "isolated polynucleotide" is found in nature, (2) is operably linked to a polynucleotide which it is not linked to in nature, or (3) does not occur in nature as part of a larger sequence. Polynucleotides in accordance with the disclosure include the nucleic acid molecules encoding the heavy chain immunoglobulin molecules shown herein, and nucleic acid molecules encoding the light chain immunoglobulin molecules shown herein.

The term "isolated protein" referred to herein means a protein of cDNA, recombinant RNA, or synthetic origin or some combination thereof, which by virtue of its origin, or source of derivation, the "isolated protein" (1) is not associated with proteins found in nature, (2) is free of other proteins from the same source, e.g., free of murine proteins, (3) is expressed by a cell from a different species, or (4) does not occur in nature.

The term "polypeptide" is used herein as a generic term to refer to native protein, fragments, or analogs of a polypeptide sequence. Hence, native protein fragments, and analogs are species of the polypeptide genus. Polypeptides in accordance with the disclosure comprise the heavy chain immunoglobulin molecules shown herein, and the light chain immunoglobulin molecules shown herein, as well as antibody molecules formed by combinations comprising the heavy chain immunoglobulin molecules with light chain immunoglobulin molecules, such as kappa light chain immunoglobulin molecules, and vice versa, as well as fragments and analogs thereof.

The term "naturally-occurring" as used herein as applied to an object refers to the fact that an object can be found in nature. For example, a polypeptide or polynucleotide sequence that is present in an organism (including viruses) that can be isolated from a source in nature and that has not been intentionally modified by man in the laboratory or otherwise is naturally-occurring.

The term "operably linked" as used herein refers to positions of components so described are in a relationship permitting them to function in their intended manner. A control sequence "operably linked" to a coding sequence is ligated in such a way that expression of the coding sequence is achieved under conditions compatible with the control sequences.

The term "control sequence" as used herein refers to polynucleotide sequences that are necessary to effect the expression and processing of coding sequences to which they are ligated. The nature of such control sequences differs depending upon the host organism in prokaryotes, such control sequences generally include promoter, ribosomal binding site, and transcription termination sequence in eukaryotes, generally, such control sequences include promoters and transcription termination sequence. The term "control sequences" is intended to include, at a minimum, all components whose presence is essential for expression and processing, and can also include additional components whose presence is advantageous, for example, leader sequences and fusion partner sequences. The term "polynucleotide" as referred to herein means nucleotides of at least 10 bases in length, either ribonucleotides or deoxynucleotides or a modified form of either type of nucleotide. The term includes single and double stranded forms of DNA.

The term oligonucleotide referred to herein includes naturally occurring, and modified nucleotides linked together by naturally occurring, and non-naturally occurring oligonucleotide linkages. Oligonucleotides are a polynucleotide subset generally comprising a length of 200 bases or fewer. In some embodiments, oligonucleotides are 10 to 60 bases in length and in some embodiments, 12, 13, 14, 15, 16, 17, 18, 19, or 20 to 40 bases in length. Oligonucleotides are usually single stranded, e.g., for probes, although oligonucleotides may be double stranded, e.g., for use in the construction of a gene mutant. Oligonucleotides of the disclosure are either sense or antisense oligonucleotides.

The term "naturally occurring nucleotides" referred to herein includes deoxyribonucleotides and ribonucleotides. The term "modified nucleotides" referred to herein includes nucleotides with modified or substituted sugar groups and the like. The term "oligonucleotide linkages" referred to herein includes oligonucleotide linkages such as phosphorothioate, phosphorodithioate, phosphoroselerloate, phosphorodiselenoate, phosphoroanilothioate, phoshoraniladate, phosphoronmidate, and the like. See e.g., LaPlanche et al. Nucl. Acids Res. 14:9081 (1986); Stec et al. J. Am. Chem. Soc. 106:6077 (1984), Stein et al. Nucl. Acids Res. 16:3209 (1988), Zon et al. Anti Cancer Drug Design 6:539 (1991); Zon et al. Oligonucleotides and Analogues: A Practical Approach, pp. 87-108 (F. Eckstein, Ed., Oxford University Press, Oxford England (1991)); Stec et al. U.S. Pat. No. 5,151,510; Uhlmann and Peyman Chemical Reviews 90:543 (1990). An oligonucleotide can include a label for detection, if desired.

As used herein, the twenty conventional amino acids and their abbreviations follow conventional usage. See Immunology—A Synthesis (2nd Edition, E. S. Golub and D. R. Green, Eds., Sinauer Associates, Sunderland, Mass. (1991)). Stereoisomers (e.g., D-amino acids) of the twenty conventional amino acids, unnatural amino acids such as α-, α-disubstituted amino acids, N-alkyl amino acids, lactic acid, and other unconventional amino acids may also be suitable components for polypeptides of the present disclosure. Examples of unconventional amino acids include: 4 hydroxyproline, γ-carboxyglutamate, ε-N,N,N-trimethyllysine, ε-N-acetyllysine, 0-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxy-terminal direction, in accordance with standard usage and convention.

Similarly, unless specified otherwise, the left-hand end of single-stranded polynucleotide sequences is the 5' end the left-hand direction of double-stranded polynucleotide sequences is referred to as the 5' direction. The direction of 5' to 3' addition of nascent RNA transcripts is referred to as the transcription direction sequence regions on the DNA strand having the same sequence as the RNA and that are 5' to the 5' end of the RNA transcript are referred to as "upstream sequences", sequence regions on the DNA strand having the same sequence as the RNA and that are 3' to the 3' end of the RNA transcript are referred to as "downstream sequences".

As applied to polypeptides, the term "substantial identity" means that two peptide sequences, when optimally aligned, such as by the programs GAP or BESTFIT using default gap weights, share at least 80 percent sequence identity, in some embodiments, at least 90 percent sequence identity, in some embodiments, at least 95 percent sequence identity, and in some embodiments, at least 99 percent sequence identity.

In some embodiments, residue positions that are not identical differ by conservative amino acid substitutions.

As discussed herein, minor variations in the amino acid sequences of antibodies or immunoglobulin molecules are contemplated as being encompassed by the present disclosure, providing that the variations in the amino acid sequence maintain at least 75%, in some embodiments, at least 80%, 90%, 95%, and in some embodiments, 99%. In particular, conservative amino acid replacements are contemplated. Conservative replacements are those that take place within a family of amino acids that are related in their side chains. Genetically encoded amino acids are generally divided into families: (1) acidic amino acids are aspartate, glutamate; (2) basic amino acids are lysine, arginine, histidine; (3) non-polar amino acids are alanine, valine, leucine, isoleucine, proline, phenylalanine, methionine, tryptophan, and (4) uncharged polar amino acids are glycine, asparagine, glutamine, cysteine, serine, threonine, tyrosine. The hydrophilic amino acids include arginine, asparagine, aspartate, glutamine, glutamate, histidine, lysine, serine, and threonine. The hydrophobic amino acids include alanine, cysteine, isoleucine, leucine, methionine, phenylalanine, proline, tryptophan, tyrosine and valine. Other families of amino acids include (i) serine and threonine, which are the aliphatic-hydroxy family; (ii) asparagine and glutamine, which are the amide containing family; (iii) alanine, valine, leucine and isoleucine, which are the aliphatic family; and (iv) phenylalanine, tryptophan, and tyrosine, which are the aromatic family. For example, it is reasonable to expect that an isolated replacement of a leucine with an isoleucine or valine, an aspartate with a glutamate, a threonine with a serine, or a similar replacement of an amino acid with a structurally related amino acid will not have a major effect on the binding or properties of the resulting molecule, especially if the replacement does not involve an amino acid within a framework site. Whether an amino acid change results in a functional peptide can readily be determined by assaying the specific activity of the polypeptide derivative. Assays are described in detail herein. Fragments or analogs of antibodies or immunoglobulin molecules can be readily prepared by those of ordinary skill in the art. Suitable amino- and carboxy-termini of fragments or analogs occur near boundaries of functional domains. Structural and functional domains can be identified by comparison of the nucleotide and/or amino acid sequence data to public or proprietary sequence databases. In some embodiments, computerized comparison methods are used to identify sequence motifs or predicted protein conformation domains that occur in other proteins of known structure and/or function. Methods to identify protein sequences that fold into a known three-dimensional structure are known. Bowie et al. Science 253:164 (1991). Thus, the foregoing examples demonstrate that those of skill in the art can recognize sequence motifs and structural conformations that may be used to define structural and functional domains in accordance with the disclosure.

Suitable amino acid substitutions are those that: (1) reduce susceptibility to proteolysis, (2) reduce susceptibility to oxidation, (3) alter binding affinity for forming protein complexes, (4) alter binding affinities, and (5) confer or modify other physicochemical or functional properties of such analogs. Analogs can include various muteins of a sequence other than the naturally-occurring peptide sequence. For example, single or multiple amino acid substitutions (for example, conservative amino acid substitutions) may be made in the naturally-occurring sequence (for example, in the portion of the polypeptide outside the domain(s) forming intermolecular contacts. A conservative amino acid substitution should not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et at. Nature 354:105 (1991).

The term "polypeptide fragment" as used herein refers to a polypeptide that has an amino terminal and/or carboxy-terminal deletion and/or one or more internal deletion(s), but where the remaining amino acid sequence is identical to the corresponding positions in the naturally-occurring sequence deduced, for example, from a full length cDNA sequence. Fragments typically are at least 5, 6, 8 or 10 amino acids long, in some embodiments, at least 14 amino acids long, in some embodiments, at least 20 amino acids long, usually at least 50 amino acids long, and in some embodiments, at least 70 amino acids long. The term "analog" as used herein refers to polypeptides that are comprised of a segment of at least 25 amino acids that has substantial identity to a portion of a deduced amino acid sequence and that has specific binding to the target, under suitable binding conditions. Typically, polypeptide analogs comprise a conservative amino acid substitution (or addition or deletion) with respect to the naturally-occurring sequence. Analogs typically are at least 20 amino acids long, in some embodiments, at least 50 amino acids long or longer, and can often be as long as a full-length naturally-occurring polypeptide.

The term "agent" is used herein to denote a chemical compound, a mixture of chemical compounds, a biological macromolecule, or an extract made from biological materials.

As used herein, the terms "label" or "labeled" refers to incorporation of a detectable marker, e.g., by incorporation of a radiolabeled amino acid or attachment to a polypeptide of biotinyl moieties that can be detected by marked avidin (e.g., streptavidin containing a fluorescent marker or enzymatic activity that can be detected by optical or calorimetric methods). In certain situations, the label or marker can also be therapeutic. Various methods of labeling polypeptides and glycoproteins are known in the art and may be used. Examples of labels for polypeptides include, but are not limited to, the following: radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$), fluorescent labels (e.g., FITC, rhodamine, lanthanide phosphors), enzymatic labels (e.g., horseradish peroxidase, p-galactosidase, luciferase, alkaline phosphatase), chemiluminescent, biotinyl groups, predetermined polypeptide epitopes recognized by a secondary reporter (e.g., leucine zipper pair sequences, binding sites for secondary antibodies, metal binding domains, epitope tags). In some embodiments, labels are attached by spacer arms of various lengths to reduce potential steric hindrance. The term "pharmaceutical agent or drug" as used herein refers to a chemical compound or composition capable of inducing a desired therapeutic effect when properly administered to a patient.

Other chemistry terms herein are used according to conventional usage in the art, as exemplified by The McGraw-Hill Dictionary of Chemical Terms (Parker, S., Ed., McGraw-Hill, San Francisco (1985)).

As used herein, "substantially pure" means an object species is the predominant species present (i.e., on a molar basis it is more abundant than any other individual species in the composition), and in some embodiments, a substantially purified fraction is a composition wherein the object species comprises at least about 50 percent (on a molar basis) of all macromolecular species present.

Generally, a substantially pure composition will comprise more than about 80 percent of all macromolecular species present in the composition, in some embodiments, more than about 85%, 90%, 95%, and 99%. In some embodiments, the object species is purified to essential homogeneity (contaminant species cannot be detected in the composition by conventional detection methods) wherein the composition consists essentially of a single macromolecular species.

The term patient includes human and veterinary subjects.

Antibodies and/or activatable antibodies of the disclosure specifically bind a given target, e.g., a human target protein such as human PDL1. Also included in the disclosure are antibodies and/or activatable antibodies that bind to the same epitope as the antibodies and/or activatable antibodies described herein. Also included in the disclosure are antibodies and/or antibodies activatable antibodies that compete with an anti-PDL1 antibody and/or an anti-PDL1 activatable antibody described herein for binding to PDL1, e.g., human PDL1. Also included in the disclosure are antibodies and/or antibodies activatable antibodies that cross-compete with an anti-PDL1 antibody and/or an anti-PDL1 activatable antibody described herein for binding to PDL1, e.g., human PDL1.

Those skilled in the art will recognize that it is possible to determine, without undue experimentation, if a monoclonal antibody (e.g., a murine monoclonal or humanized antibody) has the same specificity as a monoclonal antibody used in the methods described herein by ascertaining whether the former prevents the latter from binding to the target. If the monoclonal antibody being tested competes with the monoclonal antibody of the disclosure, as shown by a decrease in binding by the monoclonal antibody of the disclosure, then the two monoclonal antibodies bind to the same, or a closely related, epitope. An alternative method for determining whether a monoclonal antibody has the specificity of a monoclonal antibody of the disclosure is to pre-incubate the monoclonal antibody of the disclosure with the target and then add the monoclonal antibody being tested to determine if the monoclonal antibody being tested is inhibited in its ability to bind the target. If the monoclonal antibody being tested is inhibited then, in all likelihood, it has the same, or functionally equivalent, epitopic specificity as the monoclonal antibody of the disclosure.

Multispecific Activatable Antibodies

The disclosure also provides multispecific anti-PDL1 activatable antibodies. The multispecific activatable antibodies provided herein are multispecific antibodies that recognize PDL1 and at least one or more different antigens or epitopes and that include at least one masking moiety (MM) linked to at least one antigen- or epitope-binding domain of the multispecific antibody such that coupling of the MM reduces the ability of the antigen- or epitope-binding domain to bind its target. In some embodiments, the MM is coupled to the antigen- or epitope-binding domain of the multispecific antibody via a cleavable moiety (CM) that functions as a substrate for at least one protease. The activatable multispecific antibodies provided herein are stable in circulation, activated at intended sites of therapy and/or diagnosis but not in normal, i.e., healthy tissue, and, when activated, exhibit binding to a target that is at least comparable to the corresponding, unmodified multispecific antibody.

In some embodiments, the multispecific activatable antibodies are designed to engage immune effector cells, also referred to herein as immune-effector cell engaging multispecific activatable antibodies. In some embodiments, the multispecific activatable antibodies are designed to engage leukocytes, also referred to herein as leukocyte engaging multispecific activatable antibodies. In some embodiments, the multispecific activatable antibodies are designed to engage T cells, also referred to herein as T-cell engaging multispecific activatable antibodies. In some embodiments, the multispecific activatable antibodies engage a surface antigen on a leukocyte, such as on a T cell, on a natural killer (NK) cell, on a myeloid mononuclear cell, on a macrophage, and/or on another immune effector cell. In some embodiments, the immune effector cell is a leukocyte. In some embodiments, the immune effector cell is a T cell. In some embodiments, the immune effector cell is a NK cell. In some embodiments, the immune effector cell is a mononuclear cell, such as a myeloid mononuclear cell. In some embodiments, the multispecific activatable antibodies are designed to bind or otherwise interact with more than one target and/or more than one epitope, also referred to herein as multi-antigen targeting activatable antibodies. As used herein, the terms "target" and "antigen" are used interchangeably.

In some embodiments, immune effector cell engaging multispecific activatable antibodies of the disclosure include a targeting antibody or antigen-binding fragment thereof that binds PDL1 and an immune effector cell engaging antibody or antigen-binding portion thereof, where at least one of the targeting antibody or antigen-binding fragment thereof and/or the immune effector cell engaging antibody or antigen-binding portion thereof is masked. In some embodiments, the immune effector cell engaging antibody or antigen binding fragment thereof includes a first antibody or antigen-binding fragment thereof (AB1) that binds a first, immune effector cell engaging target, where the AB1 is attached to a masking moiety (MM1) such that coupling of the MM1 reduces the ability of the AB1 to bind the first target. In some embodiments, the targeting antibody or antigen-binding fragment thereof includes a second antibody or fragment thereof that includes a second antibody or antigen-binding fragment thereof (AB2) that binds PDL1, where the AB2 is attached to a masking moiety (MM2) such that coupling of the MM2 reduces the ability of the AB2 to bind PDL1. In some embodiments, the immune effector cell engaging antibody or antigen binding fragment thereof includes a first antibody or antigen-binding fragment thereof (AB1) that binds a first, immune effector cell engaging target, where the AB1 is attached to a masking moiety (MM1) such that coupling of the MIMI reduces the ability of the AB1 to bind the first target, and the targeting antibody or antigen-binding fragment thereof includes a second antibody or fragment thereof that includes a second antibody or antigen-binding fragment thereof (AB2) that binds PDL1, where the AB2 is attached to a masking moiety (MM2) such that coupling of the MM2 reduces the ability of the AB2 to bind PDL1. In some embodiments, the non-immune effector cell engaging antibody is a cancer targeting antibody. In some embodiments the non-immune cell effector antibody is an IgG. In some embodiments the immune effector cell engaging antibody is a scFv. In some embodiments the PDL1-targeting antibody (e.g., non-immune cell effector antibody) is an IgG and the immune effector cell engaging antibody is a scFv. In some embodiments, the immune effector cell is a leukocyte. In some embodiments, the immune effector cell is a T cell. In some embodiments, the immune effector cell is a NK cell. In some embodiments, the immune effector cell is a myeloid mononuclear cell.

In some embodiments, T-cell engaging multispecific activatable antibodies of the disclosure include a PDL1-targeting antibody or antigen-binding fragment thereof and a T-cell engaging antibody or antigen-binding portion thereof, where at least one of the PDL1-targeting antibody or antigen-binding fragment thereof and/or the T-cell engaging antibody or antigen-binding portion thereof is masked. In some embodiments, the T-cell engaging antibody or antigen binding fragment thereof includes a first antibody or antigen-binding fragment thereof (AB1) that binds a first, T-cell engaging target, where the AB1 is attached to a masking moiety (MM1) such that coupling of the MM1 reduces the ability of the AB1 to bind the first target. In some embodiments, the targeting antibody or antigen-binding fragment thereof includes a second antibody or fragment thereof that includes a second antibody or antigen-binding fragment thereof (AB2) that binds PDL1, where the AB2 is attached to a masking moiety (MM2) such that coupling of the MM2 reduces the ability of the AB2 to bind PDL1. In some embodiments, the T-cell engaging antibody or antigen binding fragment thereof includes a first antibody or antigen-binding fragment thereof (AB1) that binds a first, T-cell engaging target, where the AB1 is attached to a masking moiety (MM1) such that coupling of the MM1 reduces the ability of the AB1 to bind the first target, and the targeting antibody or antigen-binding fragment thereof includes a second antibody or fragment thereof that includes a second antibody or antigen-binding fragment thereof (AB2) that binds PDL1, where the AB2 is attached to a masking moiety (MM2) such that coupling of the MM2 reduces the ability of the AB2 to bind PDL1.

In some embodiments of an immune effector cell engaging multispecific activatable antibody, one antigen is PDL1, and another antigen is typically a stimulatory or inhibitory receptor present on the surface of a T-cell, natural killer (NK) cell, myeloid mononuclear cell, macrophage, and/or other immune effector cell, such as, but not limited to, B7-H4, BTLA, CD3, CD4, CD8, CD16a, CD25, CD27, CD28, CD32, CD56, CD137, CTLA-4, GITR, HVEM, ICOS, LAG3, NKG2D, OX40, PD1, TIGIT, TIM3, or VISTA. In some embodiments, the antigen is a stimulatory receptor present on the surface of a T cell or NK cell; examples of such stimulatory receptors include, but are not limited to, CD3, CD27, CD28, CD137 (also referred to as 4-1BB), GITR, HVEM, ICOS, NKG2D, and OX40. In some embodiments, the antigen is an inhibitory receptor present on the surface of a T-cell; examples of such inhibitory receptors include, but are not limited to, BTLA, CTLA-4, LAG3, PD1, TIGIT, TIM3, and NK-expressed KIRs. The antibody domain conferring specificity to the T-cell surface antigen may also be substituted by a ligand or ligand domain that binds to a T-cell receptor, a NK-cell receptor, a macrophage receptor, and/or other immune effector cell receptor, such as, but not limited to, B7-1, B7-2, B7H3, PDL1, PDL2, or TNFSF9.

In some embodiments, the T-cell engaging multispecific activatable antibody includes an anti-CD3 epsilon (CD3c, also referred to herein as CD3e and CD3) scFv and a targeting antibody or antigen-binding fragment thereof, where at least one of the anti-CD3c scFv and/or the targeting antibody or antigen-binding portion thereof is masked. In some embodiments, the CD3c scFv includes a first antibody or antigen-binding fragment thereof (AB1) that binds CD3c, where the AB1 is attached to a masking moiety (MM1) such that coupling of the MM1 reduces the ability of the AB1 to bind CD3c. In some embodiments, the targeting antibody or antigen-binding fragment thereof includes a second antibody or fragment thereof that includes a second antibody or antigen-binding fragment thereof (AB2) that binds PDL1, where the AB2 is attached to a masking moiety (MM2) such that coupling of the MM2 reduces the ability of the AB2 to bind PDL1. In some embodiments, the CD3c scFv includes a first antibody or antigen-binding fragment thereof (AB1) that binds CD3c, where the AB1 is attached to a masking moiety (MM1) such that coupling of the MM1 reduces the ability of the AB1 to bind CD3c, and the targeting antibody or antigen-binding fragment thereof includes a second antibody or fragment thereof that includes a second antibody or antigen-binding fragment thereof (AB2) that binds PDL1, where the AB2 is attached to a masking moiety (MM2) such that coupling of the MM2 reduces the ability of the AB2 to bind PDL1.

In some embodiments, the multi-antigen targeting antibodies and/or multi-antigen targeting activatable antibodies include at least a first antibody or antigen-binding fragment thereof that binds a first target and/or first epitope and a second antibody or antigen-binding fragment thereof that binds a second target and/or a second epitope. In some embodiments, the multi-antigen targeting antibodies and/or multi-antigen targeting activatable antibodies bind two or more different targets. In some embodiments, the multi-antigen targeting antibodies and/or multi-antigen targeting activatable antibodies bind two or more different epitopes on the same target. In some embodiments, the multi-antigen targeting antibodies and/or multi-antigen targeting activatable antibodies bind a combination of two or more different targets and two or more different epitopes on the same target.

In some embodiments, a multispecific activatable antibody comprising an IgG has the IgG variable domains masked. In some embodiments, a multispecific activatable antibody comprising a scFv has the scFv domains masked. In some embodiments, a multispecific activatable antibody has both IgG variable domains and scFv domains, where at least one of the IgG variable domains is coupled to a masking moiety. In some embodiments, a multispecific activatable antibody has both IgG variable domains and scFv domains, where at least one of the scFv domains is coupled to a masking moiety. In some embodiments, a multispecific activatable antibody has both IgG variable domains and scFv domains, where at least one of the IgG variable domains is coupled to a masking moiety and at least one of the scFv domains is coupled to a masking moiety. In some embodiments, a multispecific activatable antibody has both IgG variable domains and scFv domains, where each of the IgG variable domains and the scFv domains is coupled to its own masking moiety. In some embodiments, one antibody domain of a multispecific activatable antibody has specificity for a target antigen and another antibody domain has specificity for a T-cell surface antigen. In some embodiments, one antibody domain of a multispecific activatable antibody has specificity for a target antigen and another antibody domain has specificity for another target antigen. In some embodiments, one antibody domain of a multispecific activatable antibody has specificity for an epitope of a target antigen and another antibody domain has specificity for another epitope of the target antigen.

In a multispecific activatable antibody, a scFv can be fused to the carboxyl terminus of the heavy chain of an IgG activatable antibody, to the carboxyl terminus of the light chain of an IgG activatable antibody, or to the carboxyl termini of both the heavy and light chains of an IgG activatable antibody. In a multispecific activatable antibody, a scFv can be fused to the amino terminus of the heavy chain of an IgG activatable antibody, to the amino terminus of the light chain of an IgG activatable antibody, or to the amino termini of both the heavy and light chains of an IgG activatable antibody. In a multispecific activatable antibody, a scFv can be fused to any combination of one or more carboxyl termini and one or more amino termini of an IgG activatable antibody. In some embodiments, a masking moiety (MM) linked to a cleavable moiety (CM) is attached to and masks an antigen binding domain of the IgG. In some embodiments, a masking moiety (MM) linked to a cleavable moiety (CM) is attached to and masks an antigen binding domain of at least one scFv. In some embodiments, a masking moiety (MM) linked to a cleavable moiety (CM) is attached to and masks an antigen binding domain of an IgG and a masking moiety (MM) linked to a cleavable moiety (CM) is attached to and masks an antigen binding domain of at least one scFv.

The disclosure provides examples of multispecific activatable antibody structures which include, but are not limited to, the following: (VL-CL)$_2$:(VH-CH1-CH2-CH3-L4-VH*-L3-VL*-L2-CM-L1-MM)$_2$; (VL-CL)$_2$:(VH-CH1-CH2-CH3-L4-VL*-L3-VH*-L2-CM-L1-MM)$_2$; (MM-L1-CM-L2-VL-CL)$_2$: (VH-CH1-CH2-CH3-L4-VH*-L3-VL*)$_2$; (MM-L1-CM-L2-VL-CL)$_2$: (VH-CH1-CH2-CH3-L4-VL*-L3-VH*)$_2$; (VL-CL)$_2$: (MM-L1-CM-L2-VL*-L3-VH*-L4-VH-CH1-CH2-CH3)$_2$; (VL-CL)$_2$: (MM-L1-CM-L2-VH*-L3-VL*-L4-VH-CH1-CH2-CH3)$_2$; (MM-L1-CM-L2-VL-CL)$_2$: (VL*-L3-VH*-L4-VH-CH1-CH2-CH3)$_2$; (MM-L1-CM-L2-VL-CL)$_2$: (VH*-L3-VL*-L4-VH-CH1-CH2-CH3)$_2$; (VL-CL-L4-VH*-L3-VL*-L2-CM-L1-MM)$_2$: (VH-CH1-CH2-CH3)$_2$; (VL-CL-L4-VL*-L3-VH*-L2-CM-L1-MM)$_2$: (VH-CH1-CH2-CH3)$_2$; (MM-L1-CM-L2-VL*-L3-VH*-L4-VL-CL)$_2$: (VH-CH1-CH2-CH3)$_2$; (MM-L1-CM-L2-VH*-L3-VL*-L4-VL-CL)$_2$: (VH-CH1-CH2-CH3)$_2$; (VL-CL-L4-VH*-L3-VL*-L2-CM-L1-MM)$_2$: (MM-L1-CM-L2-VL*-L3-VH*-L4-VH-CH1-CH2-CH3)$_2$; (VL-CL-L4-VL*-L3-VL*-L2-CM-L1-MM)$_2$: (MM-L1-CM-L2-VH*-L3-VL*-L4-VH-CH1-CH2-CH3)$_2$; (VL-CL-L4-VL*-L3-VH*-L2-CM-L1-MM)$_2$: (MM-L1-CM-L2-VH*-L3-VL*-L4-VH-CH1-CH2-CH3)$_2$; (VL-CL-L4-VH*-L3-VL*-L2-CM-L1-MM)$_2$: (MM-L1-CM-L2-VH*-L3-VL*-L4-VH-CH1-CH2-CH3)$_2$; (VL-CL-L4-VH*-L3-VL*)$_2$: (MM-L1-CM-L2-VL*-L3-VH*-L4-VH-CH1-CH2-CH3)$_2$; (VL-CL-L4-VH*-L3-VL*)$_2$: (MM-L1-CM-L2-VL*-L3-VH*-L4-VH-CH1-CH2-CH3)$_2$; (VL-CL-L4-VL*-L3-VH*)$_2$: (MM-L1-CM-L2-VL*-L3-VH*-L4-VH-CH1-CH2-CH3)$_2$; (VL-CL-L4-VL*-L3-VH*)$_2$: (MM-L1-CM-L2-VH*-L3-VL*-L4-VH-CH1-CH2-CH3)$_2$; (VL-CL-L4-VH*-L3-VL*-L2-CM-L1-MM)$_2$: (VL*-L3-VH*-L4-VH-CH1-CH2-CH3)$_2$; (VL-CL-L4-VH*-L3-VL*-L2-CM-L1-MM)$_2$: (VH*-L3-VL*-L4-VH-CH1-CH2-CH3)$_2$; (VL-CL-L4-VL*-L3-VH*-L2-CM-L1-MM)$_2$: (VL*-L3-VH*-L4-VH-CH1-CH2-CH3)$_2$; or (VL-CL-L4-VL*-L3-VH*-L2-CM-L1-MM)$_2$: (VH*-L3-VL*-L4-VH-CH1-CH2-CH3)$_2$, wherein: VL and VH represent the light and heavy variable domains of the first specificity, contained in the IgG; VL* and VH* represent the variable domains of the second specificity, contained in the scFv; L1 is a linker peptide connecting the masking moiety (MM) and the cleavable moiety (CM); L2 is a linker peptide connecting the cleavable moiety (CM), and the antibody; L3 is a linker peptide connecting the variable domains of the scFv; L4 is a linker peptide connecting the antibody of the first specificity to the antibody of the second specificity; CL is the light-chain constant domain; and CH1, CH2, CH3 are the heavy chain constant domains. The first and second specificities may be toward any antigen or epitope.

In some embodiments of a T-cell engaging multispecific activatable antibody, one antigen is PDL1, and another antigen is typically a stimulatory (also referred to herein as activating) or inhibitory receptor present on the surface of a T-cell, natural killer (NK) cell, myeloid mononuclear cell, macrophage, and/or other immune effector cell, such as, but not limited to, B7-H4, BTLA, CD3, CD4, CD8, CD16a, CD25, CD27, CD28, CD32, CD56, CD137 (also referred to as TNFRSF9), CTLA-4, GITR, HVEM, ICOS, LAG3, NKG2D, OX40, PD1, TIGIT, TIM3, or VISTA. The antibody domain conferring specificity to the T-cell surface antigen may also be substituted by a ligand or ligand domain that binds to a T-cell receptor, a NK-cell receptor, a macrophage receptor, and/or other immune effector cell receptor, such as, but not limited to, PDL1.

In some embodiments, the targeting antibody is an anti-PDL1 antibody disclosed herein. In some embodiments, the targeting antibody can be in the form an activatable antibody. In some embodiments, the scFv(s) can be in the form of a Pro-scFv (see, e.g., WO 2009/025846, WO 2010/081173).

In some embodiments, the scFv is specific for binding CD3c, and comprises or is derived from an antibody or fragment thereof that binds CD3c, e.g., CH2527, FN18, H2C, OKT3, 2C11, UCHT1, or V9. In some embodiments, the scFv is specific for binding CTLA-4 (also referred to herein as CTLA and CTLA4).

In some embodiments, the anti-CTLA-4 scFv includes the amino acid sequence:

(SEQ ID NO: 424)
GGGSGGGGSGSGGGSGGGGSGGGEIVLIQSPGILSLSPGERATLSCRASQ

SVSSSYLATNYQQKPGQAPRLLIYGASSRATGIPDRFSGSGSGTDFILTI

SRLEPEDFAVYYCQQYGSSPLITGGGTKVEIKRSGGSTITSYNVYYTKLS

SSGTQVQLVQTGGGVVQPGRSLRLSCAASGSTFSSYAMSTNVRQAPGKGL

ETNVSAISGSGGSTYYADSVKGRFTISRDNSKNTLYLQMNSLRAEDTAVY

YCATNSLYTNYFDLTNGRGILVIVSSA

In some embodiments, the anti-CTLA-4 scFv includes the amino acid sequence that is at least 90%, 91%, 92%, 93%, 94%, 95%, 96%, 97%, 98%, 99% or more identical to the amino acid sequence of SEQ ID NO: 424.

In some embodiments, the anti-CD3ε scFv includes the amino acid sequence:

(SEQ ID NO: 425)
GGGSGGGGSGSGGGSGGGGSGGGQVQLQQSGAELARPGASVKMSCKASGY

TFTRYTMffiNVKQRPGQGLETNIGYINPSRGYTNYNQKFKDKATLITDK

SSSTAYMQLSSLTSEDSAVYYCARYYDDHYCLDYTNGQGTTLTVSSGGGG

SGGGGSGGGGSQIVLIQSPAIMSASPGEKVIMICSASSSVSYMNTNYQQK

SGTSPKRTNIYDTSKLASGVPAHERGSGSGTSYSLTISGMEAEDAATYYC

QQTNSSNPFTEGSGTKLEINR

In some embodiments, the anti-CD3ε scFv includes the amino acid sequence that is at least 90%, 91%, 92%, 93%, 94%, 95%, 96%, 97%, 98%, 99% or more identical to the amino acid sequence of SEQ ID NO: 425.

In some embodiments, the scFv is specific for binding one or more T-cells, one or more NK-cells and/or one or more macrophages. In some embodiments, the scFv is specific for binding a target selected from the group consisting of B7-H4, BTLA, CD3, CD4, CD8, CD16a, CD25, CD27, CD28, CD32, CD56, CD137, CTLA-4, GITR, HVEM, ICOS, LAG3, NKG2D, OX40, PD1, TIGIT, TIM3, or VISTA.

In some embodiments, the multispecific activatable antibody also includes an agent conjugated to the AB. In some embodiments, the agent is a therapeutic agent. In some embodiments, the agent is an antineoplastic agent. In some embodiments, the agent is a toxin or fragment thereof. In some embodiments, the agent is conjugated to the multispecific activatable antibody via a linker. In some embodiments, the agent is conjugated to the AB via a cleavable linker. In some embodiments, the linker is a non-cleavable linker. In some embodiments, the agent is a microtubule inhibitor. In some embodiments, the agent is a nucleic acid damaging agent, such as a DNA alkylator or DNA intercalator, or other DNA damaging agent. In some embodiments, the linker is a cleavable linker. In some embodiments, the agent is an agent selected from the group listed in Table 11. In some embodiments, the agent is a dolastatin. In some embodiments, the agent is an auristatin or derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid or maytansinoid derivative. In some embodiments, the agent is DM1 or DM4. In some embodiments, the agent is a duocarmycin or derivative thereof. In some embodiments, the agent is a calicheamicin or derivative thereof. In some embodiments, the agent is a pyrrolobenzodiazepine. In some embodiments, the agent is a pyrrolobenzodiazepine dimer.

In some embodiments, the multispecific activatable antibody also includes a detectable moiety. In some embodiments, the detectable moiety is a diagnostic agent.

In some embodiments, the multispecific activatable antibody naturally contains one or more disulfide bonds. In some embodiments, the multispecific activatable antibody can be engineered to include one or more disulfide bonds.

The disclosure also provides an isolated nucleic acid molecule encoding a multispecific activatable antibody described herein, as well as vectors that include these isolated nucleic acid sequences. The disclosure provides methods of producing a multispecific activatable antibody by culturing a cell under conditions that lead to expression of the activatable antibody, wherein the cell comprises such a nucleic acid molecule. In some embodiments, the cell comprises such a vector.

The disclosure also provides a method of manufacturing multispecific activatable antibodies of the disclosure by (a) culturing a cell comprising a nucleic acid construct that encodes the multispecific activatable antibody under conditions that lead to expression of the multispecific activatable, and (b) recovering the multispecific activatable antibody. Suitable AB, MM, and/or CM include any of the AB, MM, and/or CM disclosed herein.

The disclosure also provides multispecific activatable antibodies and/or multispecific activatable antibody compositions that include at least a first antibody or antigen-binding fragment thereof (AB1) that specifically binds a first target or first epitope and a second antibody or antigen-biding fragment thereof (AB2) that binds a second target or a second epitope, where at least AB1 is coupled or otherwise attached to a masking moiety (MM1), such that coupling of the MM1 reduces the ability of AB1 to bind its target. In some embodiments, the MM1 is coupled to AB1 via a first cleavable moiety (CM1) sequence that includes a substrate for a protease, for example, a protease that is co-localized with the target of AB1 at a treatment site or a diagnostic site in a subject. The multispecific activatable antibodies provided herein are stable in circulation, activated at intended sites of therapy and/or diagnosis but not in normal, i.e., healthy tissue, and, when activated, exhibit binding to the target of AB1 that is at least comparable to the corresponding, unmodified multispecific antibody. Suitable AB, MM, and/or CM include any of the AB, MM, and/or CM disclosed herein.

The disclosure also provides compositions and methods that include a multispecific activatable antibody that includes at least a first antibody or antibody fragment (AB1) that specifically binds a target and a second antibody or antibody fragment (AB2), where at least the first AB in the multispecific activatable antibody is coupled to a masking moiety (MM1) that decreases the ability of AB1 to bind its target. In some embodiments, each AB is coupled to a MM that decreases the ability of its corresponding AB to each target. For example, in bispecific activatable antibody embodiments, AB1 is coupled to a first masking moiety (MM1) that decreases the ability of AB1 to bind its target, and AB2 is coupled to a second masking moiety (MM2) that decreases the ability of AB2 to bind its target. In some embodiments, the multispecific activatable antibody comprises more than two AB regions; in such embodiments, AB1 is coupled to a first masking moiety (MM1) that decreases the ability of AB1 to bind its target, AB2 is coupled to a second masking moiety (MM2) that decreases the ability of AB2 to bind its target, AB3 is coupled to a third masking moiety (MM3) that decreases the ability of AB3 to bind its target, and so on for each AB in the multispecific activatable antibody. Suitable AB, MM, and/or CM include any of the AB, MM, and/or CM disclosed herein.

In some embodiments, the multispecific activatable antibody further includes at least one cleavable moiety (CM) that is a substrate for a protease, where the CM links a MM to an AB. For example, in some embodiments, the multispecific activatable antibody includes at least a first antibody or antibody fragment (AB1) that specifically binds a target and a second antibody or antibody fragment (AB2), where at least the first AB in the multispecific activatable antibody is coupled via a first cleavable moiety (CM1) to a masking moiety (MM1) that decreases the ability of AB1 to bind its target. In some bispecific activatable antibody embodiments, AB1 is coupled via CM1 to MM1, and AB2 is coupled via a second cleavable moiety (CM2) to a second masking moiety (MM2) that decreases the ability of AB2 to bind its target. In some embodiments, the multispecific activatable antibody comprises more than two AB regions; in some of these embodiments, AB1 is coupled via CM1 to MM1, AB2 is coupled via CM2 to MM2, and AB3 is coupled via a third cleavable moiety (CM3) to a third masking moiety (MM3) that decreases the ability of AB3 to bind its target, and so on for each AB in the multispecific activatable antibody. Suitable AB, MM, and/or CM include any of the AB, MM, and/or CM disclosed herein.

Activatable antibodies Having Non-Binding Steric Moieties or Binding Partners for Non-Binding Steric Moieties The disclosure also provides activatable antibodies that include non-binding steric moieties (NB) or binding partners (BP) for non-binding steric moieties, where the BP recruits or otherwise attracts the NB to the activatable antibody. The activatable antibodies provided herein include, for example, an activatable antibody that includes a non-binding steric moiety (NB), a cleavable linker (CL) and antibody or antibody fragment (AB) that binds a target; an activatable antibody that includes a binding partner for a non-binding steric moiety (BP), a CL and an AB; and an activatable antibody that includes a BP to which an NB has been recruited, a CL and an AB that binds the target. Activatable antibodies in which the NB is covalently linked to the CL and AB of the activatable antibody or is associated by interaction with a BP that is covalently linked to the CL and AB of the activatable antibody are referred to herein as "NB-containing activatable antibodies." By activatable or switchable is meant that the activatable antibody exhibits a first level of binding to a target when the activatable antibody is in an inhibited, masked or uncleaved state (i.e., a first conformation), and a second level of binding to the target when the activatable antibody is in an uninhibited, unmasked and/or cleaved state (i.e., a second conformation, i.e., activated antibody), where the second level of target binding is greater than the first level of target binding. The activatable antibody compositions can exhibit increased bioavailability and more favorable biodistribution compared to conventional antibody therapeutics.

In some embodiments, activatable antibodies provide for reduced toxicity and/or adverse side effects that could otherwise result from binding of the at non-treatment sites and/or non-diagnostic sites if the AB were not masked or otherwise inhibited from binding to such a site.

Anti-PDL1 activatable antibodies that include a non-binding steric moiety (NB) can be made using the methods set forth in PCT Publication No. WO 2013/192546, the contents of which are hereby incorporated by reference in their entirety.

Use Of Antibodies, Conjugated Antibodies, Activatable Antibodies, and Conjugated Activatable Antibodies It will be appreciated that administration of therapeutic entities in accordance with the disclosure will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences (15th ed, Mack Publishing Company, Easton, Pa. (1975)), particularly Chapter 87 by Blaug, Seymour, therein. These formulations include, for example, powders, pastes, ointments, jellies, waxes, oils, lipids, lipid (cationic or anionic) containing vesicles (such as Lipofectin™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. Any of the foregoing mixtures may be appropriate in treatments and therapies in accordance with the present disclosure, provided that the active ingredient in the formulation is not inactivated by the formulation and the formulation is physiologically compatible and tolerable with the route of administration. See also Baldrick P. "Pharmaceutical excipient development: the need for preclinical guidance." Regul. Toxicol Pharmacol. 32(2):210-8 (2000), Wang W. "Lyophilization and development of solid protein pharmaceuticals." Int. J. Pharm. 203(1-2):1-60 (2000), Charman WN "Lipids, lipophilic drugs, and oral drug delivery-some emerging concepts." J Pharm Sci. 89(8):967-78 (2000), Powell et al. "Compendium of excipients for parenteral formulations" PDA J Pharm Sci Technol. 52:238-311 (1998) and the citations therein for additional information related to formulations, excipients and carriers well known to pharmaceutical chemists.

Therapeutic formulations of the disclosure, which include an anti-PDL1 antibody and/or activatable anti-PDL1 antibody, such as by way of non-limiting example, an antibody, a conjugated antibody, an activatable antibody and/or a conjugated activatable antibody, are used to prevent, treat or otherwise ameliorate a disease or disorder associated with aberrant target expression and/or activity. For example, therapeutic formulations of the disclosure, which include an antibody, a conjugated antibody, an activatable antibody and/or a conjugated activatable antibody, are used to treat or otherwise ameliorate a cancer or other neoplastic condition, inflammation, an inflammatory disorder, and/or an autoimmune disease. In some embodiments, the cancer is a solid tumor or a hematologic malignancy where the target is expressed. In some embodiments, the cancer is a solid tumor where the target is expressed. In some embodiments, the cancer is a hematologic malignancy where the target is expressed. In some embodiments, the target is expressed on parenchyma (e.g., in cancer, the portion of an organ or tissue that often carries out function(s) of the organ or tissue). In some embodiments, the target is expressed on a cell, tissue, or organ. In some embodiments, the target is expressed on stroma (i.e., the connective supportive framework of a cell, tissue, or organ). In some embodiments, the target is expressed on an osteoblast. In some embodiments, the target is expressed on the endothelium (vasculature). In some embodiments, the target is expressed on a cancer stem cell. In some embodiments, the agent to which the antibody and/or the activatable antibody is conjugated is a microtubule inhibitor. In some embodiments, the agent to which the antibody and/or the activatable antibody is conjugated is a nucleic acid damaging agent.

Efficaciousness of prevention, amelioration or treatment is determined in association with any known method for diagnosing or treating the disease or disorder associated with target expression and/or activity, such as, for example, aberrant target expression and/or activity. Prolonging the survival of a subject or otherwise delaying the progression of the disease or disorder associated with target expression and/or activity, e.g., aberrant target expression and/or activity, in a subject indicates that the antibody, conjugated antibody, activatable antibody and/or conjugated activatable antibody confers a clinical benefit.

An antibody, a conjugated antibody, an activatable antibody and/or a conjugated activatable antibody can be administered in the form of pharmaceutical compositions. Principles and considerations involved in preparing such compositions, as well as guidance in the choice of components are provided, for example, in Remington: The Science And Practice Of Pharmacy 19th ed. (Alfonso R. Gennaro, et al., editors) Mack Pub. Co., Easton, Pa.: 1995; Drug Absorption Enhancement: Concepts, Possibilities, Limitations, And Trends, Harwood Academic Publishers, Langhorne, Pa., 1994; and Peptide And Protein Drug Delivery (Advances In Parenteral Sciences, Vol. 4), 1991, M. Dekker, New York.

In some embodiments where antibody fragments are used, the smallest fragment that specifically binds to the binding domain of the target protein is selected. For example, based upon the variable-region sequences of an antibody, peptide molecules can be designed that retain the ability to bind the target protein sequence. Such peptides can be synthesized chemically and/or produced by recombinant DNA technology. (See, e.g., Marasco et al., Proc. Natl. Acad. Sci. USA, 90: 7889-7893 (1993)). The formulation can also contain more than one active compounds as necessary for the particular indication being treated, for example, in some embodiments, those with complementary activities that do not adversely affect each other. In some embodiments, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients can also be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles, and nanocapsules) or in macroemulsions.

The formulations to be used for in vivo administration must be sterile. This is readily accomplished by filtration through sterile filtration membranes.

Sustained-release preparations can be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

In some embodiments, the antibody, the conjugated antibody, activatable antibody and/or conjugated activatable antibody contains a detectable label. An intact antibody, or a fragment thereof (e.g., Fab, scFv, or F(ab)$_2$) is used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the disclosure can be used to detect an analyte mRNA, protein, or genomic DNA in a biological sample in vitro as well as in vivo. For example, in vitro techniques for detection of an analyte mRNA include Northern hybridizations and in situ hybridizations. In vitro techniques for detection of an analyte protein include enzyme linked immunosorbent assays (ELISAs), Western blots, immunoprecipitations, immunochemical staining, and immunofluorescence. In vitro techniques for detection of an analyte genomic DNA include Southern hybridizations. Procedures for conducting immunoassays are described, for example in "ELISA: Theory and Practice: Methods in Molecular Biology", Vol. 42, J. R. Crowther (Ed.) Human Press, Totowa, N.J., 1995; "Immunoassay", E. Diamandis and T. Christopoulus, Academic Press, Inc., San Diego, Calif., 1996; and "Practice and Theory of Enzyme Immunoassays", P. Tijssen, Elsevier Science Publishers, Amsterdam, 1985. Furthermore, in vivo techniques for detection of an analyte protein include introducing into a subject a labeled anti-analyte protein antibody. For example, the antibody can be labeled with a radioactive marker whose presence and location in a subject can be detected by standard imaging techniques.

The antibodies, conjugated antibodies, activatable antibodies and/or conjugated activatable antibodies of the disclosure are also useful in a variety of diagnostic and prophylactic formulations. In one embodiment, an antibody, a conjugated antibody, an activatable antibody and/or a conjugated activatable antibody is administered to patients that are at risk of developing one or more of the aforementioned disorders. A patient's or organ's predisposition to one or more of the aforementioned disorders can be determined using genotypic, serological or biochemical markers.

In some embodiments of the disclosure, an antibody, a conjugated antibody, an activatable antibody and/or a conjugated activatable antibody is administered to human individuals diagnosed with a clinical indication associated with one or more of the aforementioned disorders. Upon diagnosis, an antibody, a conjugated antibody, an activatable antibody and/or a conjugated activatable antibody is administered to mitigate or reverse the effects of the clinical indication.

An antibody, a conjugated antibody, an activatable antibody, and/or a conjugated activatable antibody of the disclosure is also useful in the detection of a target in patient samples and accordingly are useful as diagnostics. For example, the antibodies and/or activatable antibodies, and conjugated versions thereof, of the disclosure are used in in vitro assays, e.g., ELISA, to detect target levels in a patient sample.

In one embodiment, an antibody, a conjugated antibody, an activatable antibody and/or a conjugated activatable antibody of the disclosure is immobilized on a solid support (e.g., the well(s) of a microtiter plate). The immobilized antibody, conjugated antibody, activatable antibody and/or conjugated activatable antibody serves as a capture antibody for any target that may be present in a test sample. Prior to contacting the immobilized antibody and/or activatable antibody, and/or conjugated versions thereof, with a patient sample, the solid support is rinsed and treated with a blocking agent such as milk protein or albumin to prevent nonspecific adsorption of the analyte.

Subsequently the wells are treated with a test sample suspected of containing the antigen, or with a solution containing a standard amount of the antigen. Such a sample is, e.g., a serum sample from a subject suspected of having levels of circulating antigen considered to be diagnostic of a pathology. After rinsing away the test sample or standard, the solid support is treated with a second antibody that is detectably labeled. The labeled second antibody serves as a detecting antibody. The level of detectable label is measured, and the concentration of target antigen in the test sample is determined by comparison with a standard curve developed from the standard samples.

It will be appreciated that based on the results obtained using the antibodies and activatable antibodies of the disclosure, and conjugated versions thereof, in an in vitro diagnostic assay, it is possible to stage a disease in a subject based on expression levels of the target antigen. For a given disease, samples of blood are taken from subjects diagnosed as being at various stages in the progression of the disease, and/or at various points in the therapeutic treatment of the disease. Using a population of samples that provides statistically significant results for each stage of progression or therapy, a range of concentrations of the antigen that may be considered characteristic of each stage is designated.

An antibody, a conjugated antibody, an activatable antibody and/or a conjugated activatable antibody can also be used in diagnostic and/or imaging methods. In some embodiments, such methods are in vitro methods. In some embodiments, such methods are in vivo methods. In some embodiments, such methods are in situ methods. In some embodiments, such methods are ex vivo methods. For example, activatable antibodies having an enzymatically cleavable CM can be used to detect the presence or absence of an enzyme that is capable of cleaving the CM. Such activatable antibodies can be used in diagnostics, which can include in vivo detection (e.g., qualitative or quantitative) of enzyme activity (or, in some embodiments, an environment of increased reduction potential such as that which can provide for reduction of a disulfide bond) through measured accumulation of activated antibodies (i.e., antibodies resulting from cleavage of an activatable antibody) in a given cell or tissue of a given host organism. Such accumulation of activated antibodies indicates not only that the tissue expresses enzymatic activity (or an increased reduction potential depending on the nature of the CM) but also that the tissue expresses target to which the activated antibody binds.

For example, the CM can be selected to be substrate for at least one protease found at the site of a tumor, at the site of a viral or bacterial infection at a biologically confined site (e.g., such as in an abscess, in an organ, and the like), and the like. The AB can be one that binds a target antigen. Using methods as disclosed herein, or when appropriate, methods familiar to one skilled in the art, a detectable label (e.g., a fluorescent label or radioactive label or radiotracer) can be conjugated to an AB or other region of an antibody and/or activatable antibody. Suitable detectable labels are discussed in the context of the above screening methods and additional specific examples are provided below. Using an AB specific to a protein or peptide of the disease state, along with at least one protease whose activity is elevated in the disease tissue of interest, activatable antibodies will exhibit an increased rate of binding to disease tissue relative to tissues where the CM specific enzyme is not present at a detectable level or is present at a lower level than in disease tissue or is inactive (e.g., in zymogen form or in complex with an inhibitor). Since small proteins and peptides are rapidly cleared from the blood by the renal filtration system, and because the enzyme specific for the CM is not present at a detectable level (or is present at lower levels in non-disease tissues or is present in inactive conformation), accumulation of activated antibodies in the disease tissue is enhanced relative to non-disease tissues.

In another example, activatable antibodies can be used to detect the presence or absence of a cleaving agent in a sample. For example, where the activatable antibodies contain a CM susceptible to cleavage by an enzyme, the activatable antibodies can be used to detect (either qualitatively or quantitatively) the presence of an enzyme in the sample. In another example, where the activatable antibodies contain a CM susceptible to cleavage by reducing agent, the activatable antibodies can be used to detect (either qualitatively or quantitatively) the presence of reducing conditions in a sample. To facilitate analysis in these methods, the activatable antibodies can be detectably labeled, and can be bound to a support (e.g., a solid support, such as a slide or bead). The detectable label can be positioned on a portion of the activatable antibody that is not released following cleavage, for example, the detectable label can be a quenched fluorescent label or other label that is not detectable until cleavage has occurred. The assay can be conducted by, for example, contacting the immobilized, detectably labeled activatable antibodies with a sample suspected of containing an enzyme and/or reducing agent for a time sufficient for cleavage to occur, then washing to remove excess sample and contaminants. The presence or absence of the cleaving agent (e.g., enzyme or reducing agent) in the sample is then assessed by a change in detectable signal of the activatable antibodies prior to contacting with the sample e.g., the presence of and/or an increase in detectable signal due to cleavage of the activatable antibody by the cleaving agent in the sample.

Such detection methods can be adapted to also provide for detection of the presence or absence of a target that is capable of binding the AB of the activatable antibodies when cleaved. Thus, the assays can be adapted to assess the presence or absence of a cleaving agent and the presence or absence of a target of interest. The presence or absence of the cleaving agent can be detected by the presence of and/or an increase in detectable label of the activatable antibodies as described above, and the presence or absence of the target can be detected by detection of a target-AB complex e.g., by use of a detectably labeled anti-target antibody.

Activatable antibodies are also useful in in situ imaging for the validation of activatable antibody activation, e.g., by protease cleavage, and binding to a particular target. In situ imaging is a technique that enables localization of proteolytic activity and target in biological samples such as cell cultures or tissue sections. Using this technique, it is possible to confirm both binding to a given target and proteolytic activity based on the presence of a detectable label (e.g., a fluorescent label).

These techniques are useful with any frozen cells or tissue derived from a disease site (e.g. tumor tissue) or healthy tissues. These techniques are also useful with fresh cell or tissue samples.

In these techniques, an activatable antibody is labeled with a detectable label. The detectable label may be a fluorescent dye, (e.g. a fluorophore, Fluorescein Isothiocyanate (FITC), Rhodamine Isothiocyanate (TRITC), an Alexa Fluor® label), a near infrared (NIR) dye (e.g., Qdot® nanocrystals), a colloidal metal, a hapten, a radioactive marker, biotin and an amplification reagent such as streptavidin, or an enzyme (e.g. horseradish peroxidase or alkaline phosphatase).

Detection of the label in a sample that has been incubated with the labeled, activatable antibody indicates that the sample contains the target and contains a protease that is specific for the CM of the activatable antibody. In some embodiments, the presence of the protease can be confirmed using broad spectrum protease inhibitors such as those described herein, and/or by using an agent that is specific for the protease, for example, an antibody such as A11, which is specific for the protease matriptase and inhibits the proteolytic activity of matriptase; see e.g., International Publication Number WO 2010/129609, published 11 Nov. 2010.

The same approach of using broad spectrum protease inhibitors such as those described herein, and/or by using a more selective inhibitory agent can be used to identify a protease that is specific for the CM of the activatable antibody. In some embodiments, the presence of the target can be confirmed using an agent that is specific for the target, e.g., another antibody, or the detectable label can be competed with unlabeled target. In some embodiments, unlabeled activatable antibody could be used, with detection by a labeled secondary antibody or more complex detection system.

Similar techniques are also useful for in vivo imaging where detection of the fluorescent signal in a subject, e.g., a mammal, including a human, indicates that the disease site contains the target and contains a protease that is specific for the CM of the activatable antibody.

These techniques are also useful in kits and/or as reagents for the detection, identification or characterization of protease activity in a variety of cells, tissues, and organisms based on the protease-specific CM in the activatable antibody.

The disclosure provides methods of using the antibodies and/or activatable antibodies in a variety of diagnostic and/or prophylactic indications. For example, the disclosure provides methods of detecting presence or absence of a cleaving agent and a target of interest in a subject or a sample by (i) contacting a subject or sample with an activatable antibody, wherein the activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MIM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent and the target are present in the subject or sample and wherein no detectable level of activated activatable antibody in the subject or sample indicates that the cleaving agent, the target or both the cleaving agent and the target are absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides methods of detecting presence or absence of a cleaving agent in a subject or a sample by (i) contacting a subject or sample with an activatable antibody in the presence of a target of interest, e.g., the target, wherein the activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent is present in the subject or sample and wherein no detectable level of activated activatable antibody in the subject or sample indicates that the cleaving agent is absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent is present in the subject or sample and wherein no detectable level of activated activatable antibody in the subject or sample indicates that the cleaving agent is absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides methods of detecting presence or absence of a cleaving agent in a subject or a sample by (i) contacting a subject or sample with an activatable antibody, wherein the activatable antibody comprises a masking moiety (MM), a cleavable moiety (CM) that is cleaved by the cleaving agent, e.g., a protease, an antigen binding domain (AB) that specifically binds the target, and a detectable label, wherein the activatable antibody in an uncleaved, non-activated state comprises a structural arrangement from N-terminus to C-terminus as follows: MM-CM-AB or AB-CM-MM; wherein the MM is a peptide that inhibits binding of the AB to the target, and wherein the MM does not have an amino acid sequence of a naturally occurring binding partner of the AB and is not a modified form of a natural binding partner of the AB; wherein, in an uncleaved, non-activated state, the MM interferes with specific binding of the AB to the target, and in a cleaved, activated state the MM does not interfere or compete with specific binding of the AB to the target; and wherein the detectable label is positioned on a portion of the activatable antibody that is released following cleavage of the CM; and (ii) measuring a level of detectable label in the subject or sample, wherein a detectable level of the detectable label in the subject or sample indicates that the cleaving agent is absent and/or not sufficiently present in the subject or sample and wherein no detectable level of the detectable label in the subject or sample indicates that the cleaving agent is present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody and/or conjugated activatable antibody (e.g., an activatable antibody to which a therapeutic agent is conjugated) described herein for use in contacting a subject or biological sample and means for detecting the level of activated activatable antibody and/or conjugated activatable antibody in the subject or biological sample, wherein a detectable level of activated activatable antibody in the subject or biological sample indicates that the cleaving agent and the target are present in the subject or biological sample and wherein no detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample.

The disclosure also provides methods of detecting presence or absence of a cleaving agent in a subject or a sample by (i) contacting a subject or biological sample with an activatable antibody in the presence of the target, and (ii) measuring a level of activated activatable antibody in the subject or biological sample, wherein a detectable level of activated activatable antibody in the subject or biological sample indicates that the cleaving agent is present in the subject or biological sample and wherein no detectable level of activated activatable antibody in the subject or biological sample indicates that the cleaving agent is absent and/or not sufficiently present in the subject or biological sample at a detectable level, such that protease cleavage of the activatable antibody cannot be detected in the subject or biological sample. Such an activatable antibody includes a masking moiety (MM), a cleavable moiety (CM) that is cleaved by the cleaving agent, e.g., a protease, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the detectable label is attached to the masking moiety. In some embodiments, the detectable label is attached to the cleavable moiety N-terminal to the protease cleavage site. In some embodiments, a single antigen binding site of the AB is masked. In some embodiments wherein an antibody of the disclosure has at least two antigen binding sites, at least one antigen binding site is masked and at least one antigen binding site is not masked. In some embodiments all antigen binding sites are masked. In some embodiments, the measuring step includes use of a secondary reagent comprising a detectable label.

The disclosure also provides kits for use in methods of detecting presence or absence of a cleaving agent and the target in a subject or a sample, where the kits include at least an activatable antibody and/or conjugated activatable antibody described herein for use in contacting a subject or biological sample with an activatable antibody in the presence of the target, and measuring a level of activated activatable antibody in the subject or biological sample, wherein a detectable level of activated activatable antibody in the subject or biological sample indicates that the cleaving agent is present in the subject or biological sample and wherein no detectable level of activated activatable antibody in the subject or biological sample indicates that the cleaving agent is absent and/or not sufficiently present in the subject or biological sample at a detectable level, such that protease cleavage of the activatable antibody cannot be detected in the subject or biological sample. Such an activatable antibody includes a masking moiety (MM), a cleavable moiety (CM) that is cleaved by the cleaving agent, e.g., a protease, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the detectable label is attached to the masking moiety. In some embodiments, the detectable label is attached to the cleavable moiety N-terminal to the protease cleavage site. In some embodiments, a single antigen binding site of the AB is masked. In some embodiments wherein an antibody of the disclosure has at least two antigen binding sites, at least one antigen binding site is masked and at least one antigen binding site is not masked. In some embodiments all antigen binding sites are masked. In some embodiments, the measuring step includes use of a secondary reagent comprising a detectable label.

The disclosure also provides kits for use in methods of detecting presence or absence of a cleaving agent in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein the activatable antibody includes a detectable label that is positioned on a portion of the activatable antibody that is released following cleavage of the CM, wherein a detectable level of activated activatable antibody in the subject or biological sample indicates that the cleaving agent is absent and/or not sufficiently present in the subject or biological sample such that the target binding and/or protease cleavage of the activatable antibody cannot be detected in the subject or biological sample, and wherein no detectable level of activated activatable antibody in the subject or biological sample indicates that the cleaving agent is present in the subject or biological sample at a detectable level.

The disclosure provides methods of detecting presence or absence of a cleaving agent and the target in a subject or a sample by (i) contacting a subject or biological sample with an activatable antibody, wherein the activatable antibody includes a detectable label that is positioned on a portion of the activatable antibody that is released following cleavage of the CM and (ii) measuring a level of activated activatable antibody in the subject or biological sample, wherein a detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample, and wherein a reduced detectable level of activated activatable antibody in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%. Such an activatable antibody includes a masking moiety (MM), a cleavable moiety (CM) that is cleaved by the cleaving agent, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein a detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample, and wherein a reduced detectable level of activated activatable antibody in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%.

The disclosure also provides methods of detecting presence or absence of a cleaving agent in a subject or a sample by (i) contacting a subject or biological sample with an activatable antibody, wherein the activatable antibody includes a detectable label that is positioned on a portion of the activatable antibody that is released following cleavage of the CM; and (ii) measuring a level of detectable label in the subject or biological sample, wherein a detectable level of the detectable label in the subject or biological sample indicates that the cleaving agent is absent and/or not sufficiently present in the subject or biological sample at a detectable level, such that protease cleavage of the activatable antibody cannot be detected in the subject or biological sample, and wherein a reduced detectable level of the detectable label in the subject or biological sample indicates that the cleaving agent is present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%. Such an activatable antibody includes a masking moiety (MM), a cleavable moiety (CM) that is cleaved by the cleaving agent, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent of interest in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein the activatable antibody includes a detectable label that is positioned on a portion of the activatable antibody that is released following cleavage of the CM, wherein a detectable level of the detectable label in the subject or biological sample indicates that the cleaving agent, the target, or both the cleaving agent and the target are absent and/or not sufficiently present in the subject or biological sample, such that the target binding and/or protease cleavage of the activatable antibody cannot be detected in the subject or biological sample, and wherein a reduced detectable level of the detectable label in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%.

In some embodiments of these methods and kits, the activatable antibody includes a detectable label. In some embodiments of these methods and kits, the detectable label includes an imaging agent, a contrasting agent, an enzyme, a fluorescent label, a chromophore, a dye, one or more metal ions, or a ligand-based label. In some embodiments of these methods and kits, the imaging agent comprises a radioisotope. In some embodiments of these methods and kits, the radioisotope is indium or technetium. In some embodiments of these methods and kits, the contrasting agent comprises iodine, gadolinium or iron oxide. In some embodiments of these methods and kits, the enzyme comprises horseradish peroxidase, alkaline phosphatase, or 0-galactosidase. In some embodiments of these methods and kits, the fluorescent label comprises yellow fluorescent protein (YFP), cyan fluorescent protein (CFP), green fluorescent protein (GFP), modified red fluorescent protein (mRFP), red fluorescent protein tdimer2 (RFP tdimer2), HCRED, or a europium derivative. In some embodiments of these methods and kits, the luminescent label comprises an N-methylacrydium derivative. In some embodiments of these methods, the label comprises an Alexa Fluor® label, such as Alex Fluor® 680 or Alexa Fluor® 750. In some embodiments of these methods and kits, the ligand-based label comprises biotin, avidin, streptavidin or one or more haptens.

In some embodiments of these methods and kits, the subject is a mammal. In some embodiments of these methods and kits, the subject is a human. In some embodiments, the subject is a non-human mammal, such as a non-human primate, companion animal (e.g., cat, dog, horse), farm animal, work animal, or zoo animal. In some embodiments, the subject is a rodent.

In some embodiments of these methods, the method is an in vivo method. In some embodiments of these methods, the method is an in situ method. In some embodiments of these methods, the method is an ex vivo method. In some embodiments of these methods, the method is an in vitro method.

In some embodiments, in situ imaging and/or in vivo imaging are useful in methods to identify which patients to treat. For example, in in situ imaging, the activatable antibodies are used to screen patient samples to identify those patients having the appropriate protease(s) and target(s) at the appropriate location, e.g., at a tumor site.

In some embodiments in situ imaging is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative for either or both of the target (e.g., the target) and the protease that cleaves the substrate in the CM in the activatable antibody being tested using these methods might be identified as suitable candidates for another form of therapy. In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease). In some embodiments, the patient is then administered a therapeutically effective amount of the activatable antibody for which the patient tested positive.

In some embodiments in vivo imaging is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative might be identified as suitable candidates for another form of therapy. In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease). In some embodiments, the patient is then administered a therapeutically effective amount of the activatable antibody for which the patient tested positive.

In some embodiments of the methods and kits, the method or kit is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested in these methods are identified as suitable candidates for treatment with such an activatable antibody comprising such a CM. Likewise, patients that test negative for both of the targets (e.g., the target) and the protease that cleaves the substrate in the CM in the activatable antibody being tested using these methods might be identified as suitable candidates for another form of therapy. In some embodiments, such patients can be tested with other activatable antibodies until a suitable activatable antibody for treatment is identified (e.g., an activatable antibody comprising a CM that is cleaved by the patient at the site of disease). In some embodiments, patients that test negative for either of the target (e.g., the target) are identified as suitable candidates for treatment with such an activatable antibody comprising such a CM. In some embodiments, patients that test negative for either of the target (e.g., the target) are identified as not being suitable candidates for treatment with such an activatable antibody comprising such a CM. In some embodiments, such patients can be tested with other activatable antibodies until a suitable activatable antibody for treatment is identified (e.g., an activatable antibody comprising a CM that is cleaved by the patient at the site of disease). In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

In some embodiments, a method or kit is used to identify or otherwise refine a patient population suitable for treatment with an anti-the target activatable antibody and/or conjugated activatable antibody (e.g., activatable antibody to which a therapeutic agent is conjugated) of the disclosure, followed by treatment by administering that activatable antibody and/or conjugated activatable antibody to a subject in need thereof. For example, patients that test positive for both the targets (e.g., the target) and a protease that cleaves the substrate in the cleavable moiety (CM) of the activatable antibody and/or conjugated activatable antibody being tested in these methods are identified as suitable candidates for treatment with such antibody and/or such a conjugated activatable antibody comprising such a CM, and the patient is then administered a therapeutically effective amount of the activatable antibody and/or conjugated activatable antibody that was tested. Likewise, patients that test negative for either or both of the target (e.g., the target) and the protease that cleaves the substrate in the CM in the activatable antibody being tested using these methods might be identified as suitable candidates for another form of therapy. In some embodiments, such patients can be tested with other activatable antibody and/or conjugated activatable antibody until a suitable antibody and/or conjugated activatable antibody for treatment is identified (e.g., an activatable antibody and/or conjugated activatable antibody comprising a CM that is cleaved by the patient at the site of disease). In some embodiments, the patient is then administered a therapeutically effective amount of the activatable antibody and/or conjugated activatable antibody for which the patient tested positive.

In some embodiments of these methods and kits, the MM is a peptide having a length from about 4 to 40 amino acids. In some embodiments of these methods and kits, the activatable antibody comprises a linker peptide, wherein the linker peptide is positioned between the MM and the CM. In some embodiments of these methods and kits, the activatable antibody comprises a linker peptide, where the linker peptide is positioned between the AB and the CM. In some embodiments of these methods and kits, the activatable antibody comprises a first linker peptide (L1) and a second linker peptide (L2), wherein the first linker peptide is positioned between the MM and the CM and the second linker peptide is positioned between the AB and the CM. In some embodiments of these methods and kits, each of L1 and L2 is a peptide of about 1 to 20 amino acids in length, and wherein each of L1 and L2 need not be the same linker. In some embodiments of these methods and kits, one or both of L1 and L2 comprises a glycine-serine polymer. In some embodiments of these methods and kits, at least one of L1 and L2 comprises an amino acid sequence selected from the group consisting of $(GS)_n$, $(GSGGS)_n$ (SEQ ID NO: 191) and $(GGGS)_n$ (SEQ ID NO: 192), where n is an integer of at least one. In some embodiments of these methods and kits, at least one of L1 and L2 comprises an amino acid sequence having the formula $(GGS)_n$, where n is an integer of at least one. In some embodiments of these methods and kits, at least one of L1 and L2 comprises an amino acid sequence selected from the group consisting of Gly-Gly-Ser-Gly (SEQ ID NO: 193), Gly-Gly-Ser-Gly-Gly (SEQ ID NO: 194), Gly-Ser-Gly-Ser-Gly (SEQ ID NO: 195), Gly-Ser-Gly-Gly-Gly (SEQ ID NO: 196), Gly-Gly-Gly-Ser-Gly (SEQ ID NO: 197), and Gly-Ser-Ser-Ser-Gly (SEQ ID NO: 198).

In some embodiments of these methods and kits, the AB comprises an antibody or antibody fragment sequence selected from the cross-reactive antibody sequences presented herein. In some embodiments of these methods and kits, the AB comprises a Fab fragment, a scFv or a single chain antibody (scAb).

In some embodiments of these methods and kits, the cleaving agent is a protease that is co-localized in the subject or sample with the target and the CM is a polypeptide that functions as a substrate for the protease, wherein the protease cleaves the CM in the activatable antibody when the activatable antibody is exposed to the protease. In some embodiments of these methods and kits, the CM is a polypeptide of up to 15 amino acids in length. In some embodiments of these methods and kits, the CM is coupled to the N-terminus of the AB. In some embodiments of these methods and kits, the CM is coupled to the C-terminus of the AB. In some embodiments of these methods and kits, the CM is coupled to the N-terminus of a VL chain of the AB.

The antibodies, conjugated antibodies, activatable antibodies and/or conjugated activatable antibodies of the disclosure are used in diagnostic and prophylactic formulations. In one embodiment, an activatable antibody is administered to patients that are at risk of developing one or more of the aforementioned inflammation, inflammatory disorders, cancer or other disorders.

A patient's or organ's predisposition to one or more of the aforementioned disorders can be determined using genotypic, serological or biochemical markers.

In some embodiments of the disclosure, an antibody, a conjugated antibody, an activatable antibody and/or a conjugated activatable antibody is administered to human individuals diagnosed with a clinical indication associated with one or more of the aforementioned disorders. Upon diagnosis, an antibody, a conjugated antibody, an activatable antibody and/or a conjugated activatable antibody is administered to mitigate or reverse the effects of the clinical indication.

Antibodies, conjugated antibodies, activatable antibodies and/or conjugated activatable antibodies of the disclosure are also useful in the detection of the target in patient samples and accordingly are useful as diagnostics. For example, the antibodies, conjugated antibodies, the activatable antibodies and/or conjugated activatable antibodies of the disclosure are used in in vitro assays, e.g., ELISA, to detect target levels in a patient sample.

In one embodiment, an antibody and/or activatable antibody of the disclosure is immobilized on a solid support (e.g., the well(s) of a microtiter plate). The immobilized antibody and/or activatable antibody serves as a capture antibody for any target that may be present in a test sample. Prior to contacting the immobilized antibody and/or activatable antibody with a patient sample, the solid support is rinsed and treated with a blocking agent such as milk protein or albumin to prevent nonspecific adsorption of the analyte.

Subsequently the wells are treated with a test sample suspected of containing the antigen, or with a solution containing a standard amount of the antigen. Such a sample is, e.g., a serum sample from a subject suspected of having levels of circulating antigen considered to be diagnostic of a pathology. After rinsing away the test sample or standard, the solid support is treated with a second antibody that is detectably labeled. The labeled second antibody serves as a detecting antibody. The level of detectable label is measured, and the concentration of target antigen in the test sample is determined by comparison with a standard curve developed from the standard samples.

It will be appreciated that based on the results obtained using the antibodies and/or activatable antibodies of the disclosure in an in vitro diagnostic assay, it is possible to stage a disease in a subject based on expression levels of the Target antigen. For a given disease, samples of blood are taken from subjects diagnosed as being at various stages in the progression of the disease, and/or at various points in the therapeutic treatment of the disease. Using a population of samples that provides statistically significant results for each stage of progression or therapy, a range of concentrations of the antigen that may be considered characteristic of each stage is designated.

Antibodies, conjugated antibodies, activatable antibodies and/or conjugated activatable antibodies can also be used in diagnostic and/or imaging methods. In some embodiments, such methods are in vitro methods. In some embodiments, such methods are in vivo methods. In some embodiments, such methods are in situ methods. In some embodiments, such methods are ex vivo methods. For example, activatable antibodies having an enzymatically cleavable CM can be used to detect the presence or absence of an enzyme that is capable of cleaving the CM. Such activatable antibodies can be used in diagnostics, which can include in vivo detection (e.g., qualitative or quantitative) of enzyme activity (or, in some embodiments, an environment of increased reduction potential such as that which can provide for reduction of a disulfide bond) through measured accumulation of activated antibodies (i.e., antibodies resulting from cleavage of an activatable antibody) in a given cell or tissue of a given host organism. Such accumulation of activated antibodies indicates not only that the tissue expresses enzymatic activity (or an increased reduction potential depending on the nature of the CM) but also that the tissue expresses target to which the activated antibody binds.

For example, the CM can be selected to be a protease substrate for a protease found at the site of a tumor, at the site of a viral or bacterial infection at a biologically confined site (e.g., such as in an abscess, in an organ, and the like), and the like. The AB can be one that binds a target antigen. Using methods familiar to one skilled in the art, a detectable label (e.g., a fluorescent label or radioactive label or radiotracer) can be conjugated to an AB or other region of an activatable antibody. Suitable detectable labels are discussed in the context of the above screening methods and additional specific examples are provided below. Using an AB specific to a protein or peptide of the disease state, along with a protease whose activity is elevated in the disease tissue of interest, activatable antibodies will exhibit an increased rate of binding to disease tissue relative to tissues where the CM specific enzyme is not present at a detectable level or is present at a lower level than in disease tissue or is inactive (e.g., in zymogen form or in complex with an inhibitor). Since small proteins and peptides are rapidly cleared from the blood by the renal filtration system, and because the enzyme specific for the CM is not present at a detectable level (or is present at lower levels in non-disease tissues or is present in inactive conformation), accumulation of activated antibodies in the disease tissue is enhanced relative to non-disease tissues.

In another example, activatable antibodies can be used to detect the presence or absence of a cleaving agent in a sample. For example, where the activatable antibodies contain a CM susceptible to cleavage by an enzyme, the activatable antibodies can be used to detect (either qualitatively or quantitatively) the presence of an enzyme in the sample. In another example, where the activatable antibodies contain a CM susceptible to cleavage by reducing agent, the activatable antibodies can be used to detect (either qualitatively or quantitatively) the presence of reducing conditions in a sample. To facilitate analysis in these methods, the activatable antibodies can be detectably labeled, and can be bound to a support (e.g., a solid support, such as a slide or bead). The detectable label can be positioned on a portion of the activatable antibody that is not released following cleavage, for example, the detectable label can be a quenched fluorescent label or other label that is not detectable until cleavage has occurred. The assay can be conducted by, for example, contacting the immobilized, detectably labeled activatable antibodies with a sample suspected of containing an enzyme and/or reducing agent for a time sufficient for cleavage to occur, then washing to remove excess sample and contaminants. The presence or absence of the cleaving agent (e.g., enzyme or reducing agent) in the sample is then assessed by a change in detectable signal of the activatable antibodies prior to contacting with the sample e.g., the presence of and/or an increase in detectable signal due to cleavage of the activatable antibody by the cleaving agent in the sample.

Such detection methods can be adapted to also provide for detection of the presence or absence of a target that is capable of binding the AB of the activatable antibodies when cleaved. Thus, the assays can be adapted to assess the presence or absence of a cleaving agent and the presence or absence of a target of interest. The presence or absence of the cleaving agent can be detected by the presence of and/or an increase in detectable label of the activatable antibodies as described above, and the presence or absence of the target can be detected by detection of a target-AB complex e.g., by use of a detectably labeled anti-target antibody.

Activatable antibodies are also useful in in situ imaging for the validation of activatable antibody activation, e.g., by protease cleavage, and binding to a particular target. In situ imaging is a technique that enables localization of proteolytic activity and target in biological samples such as cell cultures or tissue sections. Using this technique, it is possible to confirm both binding to a given target and proteolytic activity based on the presence of a detectable label (e.g., a fluorescent label).

These techniques are useful with any frozen cells or tissue derived from a disease site (e.g. tumor tissue) or healthy tissues. These techniques are also useful with fresh cell or tissue samples.

In these techniques, an activatable antibody is labeled with a detectable label. The detectable label may be a fluorescent dye, (e.g. Fluorescein Isothiocyanate (FITC), Rhodamine Isothiocyanate (TRITC), a near infrared (NIR) dye (e.g., Qdot® nanocrystals), a colloidal metal, a hapten, a radioactive marker, biotin and an amplification reagent such as streptavidin, or an enzyme (e.g. horseradish peroxidase or alkaline phosphatase).

Detection of the label in a sample that has been incubated with the labeled, activatable antibody indicates that the sample contains the target and contains a protease that is specific for the CM of the activatable antibody. In some embodiments, the presence of the protease can be confirmed using broad spectrum protease inhibitors such as those described herein, and/or by using an agent that is specific for the protease, for example, an antibody such as A11, which is specific for the protease matriptase and inhibits the proteolytic activity of matriptase; see e.g., International Publication Number WO 2010/129609, published 11 Nov. 2010. The same approach of using broad spectrum protease inhibitors such as those described herein, and/or by using a more selective inhibitory agent can be used to identify a protease or class of proteases specific for the CM of the activatable antibody. In some embodiments, the presence of the target can be confirmed using an agent that is specific for the target, e.g., another antibody, or the detectable label can be competed with unlabeled target. In some embodiments, unlabeled activatable antibody could be used, with detection by a labeled secondary antibody or more complex detection system.

Similar techniques are also useful for in vivo imaging where detection of the fluorescent signal in a subject, e.g., a mammal, including a human, indicates that the disease site contains the target and contains a protease that is specific for the CM of the activatable antibody.

These techniques are also useful in kits and/or as reagents for the detection, identification or characterization of protease activity in a variety of cells, tissues, and organisms based on the protease-specific CM in the activatable antibody.

In some embodiments, in situ imaging and/or in vivo imaging are useful in methods to identify which patients to treat. For example, in in situ imaging, the activatable antibodies are used to screen patient samples to identify those patients having the appropriate protease(s) and target(s) at the appropriate location, e.g., at a tumor site.

In some embodiments in situ imaging is used to identify or otherwise refine a patient population suitable for treatment with an activatable antibody of the disclosure. For example, patients that test positive for both the target and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative for either or both of the target and the protease that cleaves the substrate in the CM in the activatable antibody being tested using these methods are identified as suitable candidates for another form of therapy (i.e., not suitable for treatment with the activatable antibody being tested). In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease).

In some embodiments in vivo imaging is used to identify or otherwise refine a patient population suitable for treatment with an activatable antibody of the disclosure. For example, patients that test positive for both the target and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative are identified as suitable candidates for another form of therapy (i.e., not suitable for treatment with the activatable antibody being tested). In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease).

Pharmaceutical Compositions

The antibodies, conjugated antibodies, activatable antibodies and/or conjugated activatable antibodies of the disclosure (also referred to herein as "active compounds"), and derivatives, fragments, analogs and homologs thereof, can be incorporated into pharmaceutical compositions suitable for administration. Such compositions typically comprise the antibody, the conjugated antibody, activatable antibody and/or conjugated activatable antibody and a pharmaceutically acceptable carrier. As used herein, the term "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Suitable examples of such carriers or diluents include, but are not limited to, water, saline, ringer's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the disclosure is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfate; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL' (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In some embodiments, it will be desirable to include isotonic agents, for example, sugars, polyalcohols such as manitol, sorbitol, sodium chloride in the composition. Prolonged absorption of the injectable compositions can be brought about by including in the composition an agent that delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser that contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the particular therapeutic effect to be achieved, and the limitations inherent in the art of compounding such an active compound for the treatment of individuals.

The pharmaceutical compositions can be included in a container, pack, or dispenser together with instructions for administration.

The invention will be further described in the following examples, which do not limit the scope of the invention described in the claims.

EXAMPLES

Example 1. Selection of Human ScFvs of the Embodiments that Bind Human and/or Mouse PDL1

This Example demonstrates that ScFvs (single-chain variable fragments) of the embodiments that bind PDL1 can be selected from a phage display library of ScFvs with diverse CDR sequences, and that such binding can inhibit PDL1 binding to PD1 and B7-1.

ScFvs were selected from a fully human ScFv library displayed on M13 bacteriophage; ScFv phage selection was conducted under contract with Creative Biolabs, Shirley, N.Y. A fusion protein comprised of the extracellular domain (ECD) of human PDL1 or mouse PDL1, with a carboxy terminal His6 tag (SEQ ID NO: 1204)(Sino Biological, Cat. No. 10084-H02H-200) was used as the antigen in three alternating rounds of selection for ScFvs displayed on M13 bacteriophage that bind PDL1. In the first round, bound phage were released by trypsin digestion, and in subsequent rounds, phage were eluted by human PD1 fusion protein (R&D Systems; Cat. No. 1080-PD-050) competition. Five (5) unique ScFvs that bind PDL1 were isolated. Table 1 lists the 5 ScFvs and SEQ ID NOs of their respective nucleic acid sequences and amino acid sequences.

TABLE 1

| SEQ ID NOs of selected ScFvs | | |
|---|---|---|
| ScFv | Nucleic acid sequence | Amino acid sequence |
| PDL1 c8 | SEQ ID NO: 1 | SEQ ID NO: 2 |
| PDL1 c12 | SEQ ID NO: 3 | SEQ ID NO: 4 |
| PDL1 c16 | SEQ ID NO: 5 | SEQ ID NO: 6 |
| PDL1 c20 | SEQ ID NO: 7 | SEQ ID NO: 8 |
| PDL1 c60 | SEQ ID NO: 9 | SEQ ID NO: 10 |

The nucleic acid and amino acid sequences of each of the anti-PDL1 ScFvs (with CDRs underlined) are shown below:

```
                                        SEQ ID NO: 1
GAGGTGCAGCTGTTGGAGTCTGGGGGAGGCTTGGTACAGCCTGGGGGGTC
CCTGAGACTCTCCTGTGCAGCCTCTGGATTCACCTTTAGCAGCTATGCCA
TGAGCTGGGTCCGCCAGGCTCCAGGGAAGGGGCTGGAGTGGGTCTCAGAT
ATTACTGCGTCGGGTTAGAGGACAACGTACGCAGACTCCGTGAAGGGCCG
GTTCACCATCTCCAGAGACAATTCCAAGAACACGCTGTATCTGCAAATGA
ACAGCCTGAGAGCCGAGGACACGGCCGTATATTACTGTGCGAGATCGAAG
ATTGCTTTTGACTACTGGGGCCAGGGAACCCTGGTCACCGTCTCGAGCGG
TGGAGGCGGTTCAGGCGGAGGTGGCAGCGGCGGTGGCGGGTCGACGGACA
TCCAGATGACCCAGTCTCCATCCTCCCTGTCTGCATCTGTAGGAGACAGA
GTCACCATCACTTGCCGGGCAAGTCAGAGCATTAGCAGCTATTTAAATTG
GTATCAGCAGAAACCAGGGAAAGCCCCTAAGCTCCTGATCTATAAGGCAT
CCCGTTTGCAAAGTGGGGTCCCATCAAGGTTCAGTGGCAGTGGATCTGGG
ACAGATTTCACTCTCACCATCAGCAGTCTGCAACCTGAAGATTTTGCAAC
TTACTACTGTCAACAGCGTGCGCTTAAGCCTGTGACGTTCGGCCAAGGGA
CCAAGGTGGAAATCAAACGG

SEQ ID NO: 2
EVQLLESGGGLVQPGGSLRLSCAASGFTFSSYAMSWVRQAPGKGLEWVSD
ITASGQRTTYADSVKGRFTISRDNSKNTLYLQMNSLRAEDTAVYYCARSK
IAFDYWGQGTLVTVSSGGGGSGGGGSGGGGSTDIQMTQSPSSLSASVGDR
VTITCRASQSISSYLNWYQQKPGKAPKLLIYKASRLQSGVPSRFSGSGSG
TDFTLTISSLQPEDFATYYCQQRALKPVTFGQGTKVEIKR

SEQ ID NO: 3
GAGGTGCAGCTGTTGGAGTCTGGGGGAGGCTTGGTACAGCCTGGGGGGTC
CCTGAGACTATCCTGTGCAGCCTCTGGATTCACCTTTAGCAGCTATGCCA
TGAGCTGGGTCCGCCAGGCTCCAGGGAAGGGGCTGGAGTGGGTCTCAAGT
ATTAATAAGGATGGTCATTATACAAGTTACGCAGACTCCGTGAAGGGCCG
GTTCACCATCTCCAGAGACAATTCCAAGAACACGCTGTATCTGCAAATGA
ACAGCCTGAGAGCCGAGGACACGGCCGTATATTACTGTGCGAAAAATCTT
GATGAGTTTGACTACTGGGGCCAGGGAACCCTGGTCACCGTCTCGAGCGG
TGGAGGCGGTTCAGGCGGAGGTGGCAGCGGCGGTGGCGGGTCGACGGACA
TCCAGATGACCCAGTCTCCATCCTCCCTGTCTGCATCTGTAGGAGACAGA
GTCACCATCACTTGCCGGGCAAGTCAGAGCATTAGCAGCTATTTAAATTG
GTATCAGCAGAAACCAGGGAAAGCCCCTAAGCTCCTGATCTATGCTGCAT
CCAGTTTGCAAAGTGGGGTCCCATCAAGGTTCAGTGGCAGTGGATCTGGG
ACAGATTTCACTCTCACCATCAGCAGTCTGCAACCTGAAGATTTTGCAAC
TTACTACTGTCAACAGAGTTACAGTACCCCTAATACGTTCGGCCAAGGGA
CCAAGGTGGAAATCAAACGG

SEQ ID NO: 4
EVQLLESGGGLVQPGGSLRLSCAASGFTFSSYAMSWVRQAPGKGLEWVSS
INKDGHYTSYADSVKGRFTISRDNSKNTLYLQMNSLRAEDTAVYYCAKNL
DEFDYWGQGTLVTVSSGGGGSGGGGSGGGGSTDIQMTQSPSSLSASVGDR
VTITCRASQSISSYLNWYQQKPGKAPKLLIYAASSLQSGVPSRFSGSGSG
TDFTLTISSLQPEDFATYYCQQSYSTPNTFGQGTKVEIKR

SEQ ID NO: 5
GAGGTGCAGCTGTTGGAGTCTGGGGGAGGCTTGGTACAGCCTGGGGGGTC
CCTGAGACTCTCCTGTGCAGCCTCTGGATTCACCTTTAGCAGCTATGCCA
TGAGCTGGGTCCGCCAGGCTCCAGGGAAGGGGCTGGAGTGGGTCTCATCT
ATTATGGCTACTGGTGCTGGTACATTGTACGCAGACTCCGTGAAGGGCCG
GTTCACCATCTCCAGAGACAATTCCAAGAACACGCTGTATCTGCAAATGA
ACAGCCTGAGAGCCGAGGACACGGCCGTATATTACTGTGCGAAAGATGGT
GCGGGGTTTGACTACTGGGGCCAGGGAACCCTGGTCACCGTCTCGAGCGG
TGGAGGCGGTTCAGGCGGAGGTGGCAGCGGCGGTGGCGGGTCGACGGACA
TCCAGATGACCCAGTCTCCATCCTCCCTGTCTGCATCTGTAGGAGACAGA
GTCACCATCACTTGCCGGGCAAGTCAGAGCATTAGCAGCTATTTAAATTG
GTATCAGCAGAAACCAGGGAAAGCCCCTAAGCTCCTGATCTATTCTGCAT
CCCAGTTGCAAAGTGGGGTCCCATCAAGGTTCAGTGGCAGTGGATCTGGG
ACAGATTTCACTCTCACCATCAGCAGTCTGCAACCTGAAGATTTTGCAAC
```

```
TTACTACTGTCAACAGGCGAATTCGCGGCCTTCTACGTTCGGCCAAGGGA

CCAAGGTGGAAATCAAACGG
```

SEQ ID NO: 6
```
EVQLLESGGGLVQPGGSLRLSCAASGFTFSSYAMSWVRQAPGKGLEWVSS

IMATGAGTLYADSVKGRFTISRDNSKNTLYLQMNSLRAEDTAVYYCAKDG

AGFDYWGQGTLVTVSSGGGGSGGGGSGGGGSTDIQMTQSPSSLSASVGDR

VTITCRASQSISSYLNWYQQKPGKAPKLLIYSASQLQSGVPSRFSGSGSG

TDFTLTISSLQPEDFATYYCQQANSRPSTFGQGTKVEIKR
```

SEQ ID NO: 7
```
GAGGTGCAGCTGTTGGAGTCTGGGGGAGGCTTGGTACAGCCTGGGGGTC

CCTGAGACTCTCCTGTGCAGCCTCTGGATTCACCTTTAGCAGCTATGCCA

TGAGCTGGGTCCGCCAGGCTCCAGGGAAGGGGCTGTAGTGGGTCTCAACT

ATTACTTCTTCTGGTGCTGCTACATATTACGCAGACTCCGTGAAGGGCCG

GTTCACCATCTCCAGAGACAATTCCAAGAACACGCTGTATCTGCAAATGA

ACAGCCTGAGAGCCGAGGACACGGCCGTATATTACTGTGCGAAAAATTAT

ACTGGTTTTGACTACTGGGGCCAGGGAACCCTGGTCACCGTCTCGAGCG

TGGAGGCGGTTCAGGCGGAGGTGGCAGCGGCGGTGGCGGGTCGACGGACA

TCCAGATGACCCAGTCTCCATCCTCCCTGTCTGCATCTGTAGGAGACAGA

GTCACCATCACTTGCCGGGCAAGTCAGAGCATTAGCAGCTATTTAAATTG

GTATCAGCAGAAACCAGGGAAAGCCCCTAAGCTCCTGATCTATAATGCAT

CCTCCTTGCAAAGTGGGGTCCCATCAAGGTTCAGTGGCAGTGGATCTGGG

ACAGATTTCACTCTCACCATCAGCAGTCTGCAACCTGAAGATTTTGCAAC

TTACTACTGTCAACAGTATACTTATGGTCCTGGTACGTTCGGCCAAGGGA

CCAAGGTGGAAATCAAACGG
```

SEQ ID NO: 8
```
EVQLLESGGGLVQPGGSLRLSCAASGFTFSSYAMSWVRQAPGKGLQWVST

ITSSGAATYYADSVKGRFTISRDNSKNTLYLQMNSLRAEDTAVYYCAKNY

TGFDYWGQGTLVTVSSGGGGSGGGGSGGGGSTDIQMTQSPSSLSASVGDR

VTITCRASQSISSYLNWYQQKPGKAPKLLIYNASSLQSGVPSRFSGSGSG

TDFTLTISSLQPEDFATYYCQQYTYGPGTFGQGTKVEIKR
```

SEQ ID NO: 9
```
GAGGTGCAGCTGTTGGAGTCTGGGGGAGGCTTGGTACAGCCTGGGGGTC

CCTGAGACTCTCCTGTGCAGCCTCTGGATTCACCTTTAGCAGCTATGCCA

TGAGCTGGGTCCGCCAGGCTCCAGGGAAGGGGCTGGAGTGGGTCTCAAGT

ATTTATTCTACTGGTGGTGCTACAGCTTACGCAGACTCCGTGAAGGGCCG

GTTCACCATCTCCAGAGACAATTCCAAGAACACGCTGTATCTGCAAATGA

ACAGCCTGAGAGCCGAGGACACGGCCGTATATTACTGTGCGAAATCTTCT

GCTGGTTTTGACTACTGGGGCCAGGGAACCCTGGTCACCGTCTCGAGCG

TGGAGGCGGTTCAGGCGGAGGTGGCAGCGGCGGTGGCGGGTCGACGGACA

TCCAGATGACCCAGTCTCCATCCTCCCTGTCTGCATCTGTAGGAGACAGA

GTCACCATCACTTGCCGGGCAAGTCAGAGCATTAGCAGCTATTTAAATTG

GTATCAGCAGAAACCAGGGAAAGCCCCTAAGCTCCTGATCTATTATGCAT

CCACTTTGCAAAGTGGGGTCCCATCAAGGTTCAGTGGCAGTGGATCTGGG

ACAGATTTCACTCTCACCATCAGCAGTCTGCAACCTGAAGATTTTGCAAC

TTACTACTGTCAACAGGATAATGGTTATCCTTCTACGTTCGGCCAAGGGA

CCAAGGTGGAAATCAAACGG
```

SEQ ID NO: 10
```
EVQLLESGGGLVQPGGSLRLSCAASGFTFSSYAMSWVRQAPGKGLEWVSS

IYSTGGATAYADSVKGRFTISRDNSKNTLYLQMNSLRAEDTAVYYCAKSS

AGFDYWGQGTLVTVSSGGGGSGGGGSGGGGSTDIQMTQSPSSLSASVGDR

VTITCRASQSISSYLNWYQQKPGKAPKLLIYYASTLQSGVPSRFSGSGSG

TDFTLTISSLQPEDFATYYCQQDNGYPSTFGQGTKVEIKR
```

FIG. 1A shows by ELISA-based binding that PDL1 c60 ScFv-phage binds specifically to human and mouse PDL1. Briefly, human PDL1, mouse PDL1, human PD1, mouse PD1, human 41BBLig or Notch1 (R&D Systems) were adsorbed to separate wells of a 96-well ELISA plate. Phage were applied to the plate and allowed to bind. Bound phage were visualized with an anti-M13-HRP conjugate (GE Healthcare, Piscataway, N.Y.) and developed with the chromogenic substrate tetramethyl benzidine (TMB) (Thermo Scientific, Rockford, Ill.).

Figure 2:
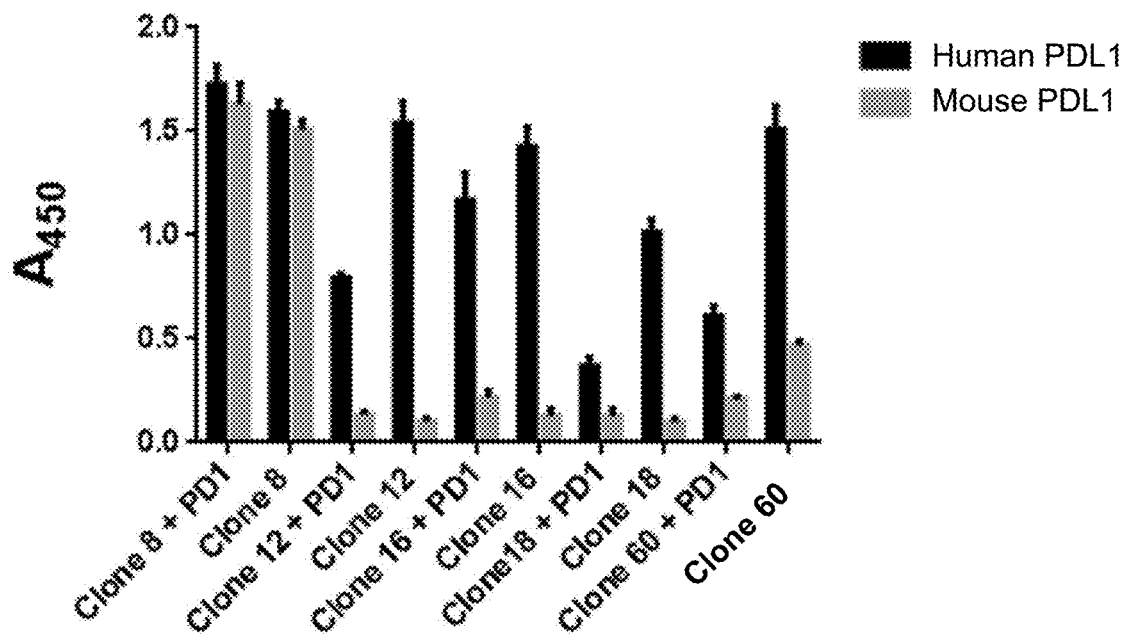
FIG. 2 is a graph depicting that hPD1 inhibits the binding of clones 12, 18 and 60 to hPDL1 in an ELISA format, and, furthermore mPD1 inhibits the binding of clone 60 to mPDL1.

FIG. 2A shows that inclusion of PD1 can inhibit the binding of PDL1 ScFv-phage binding to PDL1 in an ELISA binding assay. Briefly, human PDL1 or mouse PDL1 (R&D Systems) was adsorbed to separate wells of a 96-well ELISA plate. Phage were applied to the plate in the presence or absence of human or mouse PD1-Fc (R&D Systems) and allowed to bind. Bound phage were visualized with an anti-M13-HRP conjugate (GE Healthcare, Piscataway, N.Y.) and developed with the chromogenic substrate tetramethyl benzidine (TMB) (Thermo Scientific, Rockford, Ill.). Phage binding was reduced in the presence of PD1-Fc, demonstrating that the binding epitope of the phage overlaps with that of PD1 binding.

Example 2. Production and Testing of Fully Human Anti-PDL1 c60 IgG Antibodies

This Example demonstrates that PDL1 c60 ScFv-phage that bind human and mouse PDL1 can be converted into fully human IgG antibodies that retain human and mouse PDL1 binding.

Production of fully human IgGs comprising the variable domains of PDL1 c60 was accomplished using techniques similar to those described in PCT Publication No. WO 2010/081173. DNA molecules encoding the variable domains of PDL1 c60 ScFv-phage were cloned into expression vectors for the expression of fully human IgGs. Light chain (Lc) variable domains were amplified from the ScFv templates. Vector (LcpOP (modified from pCDNA3, Invitrogen, Carlsbad, Calif.)) and amplified DNA were cut with BsiWI and EcoRI overnight, combined by ligation and transformed into E. coli MC1061 cells. Heavy chain (Hc) variable domains were amplified from ScFv templates. Fully human IgGs anti-PDL1 c60 were expressed from transiently transfected HEK-293 cells and purified from the culture supernatant by Protein A chromatography.

Figure 3:
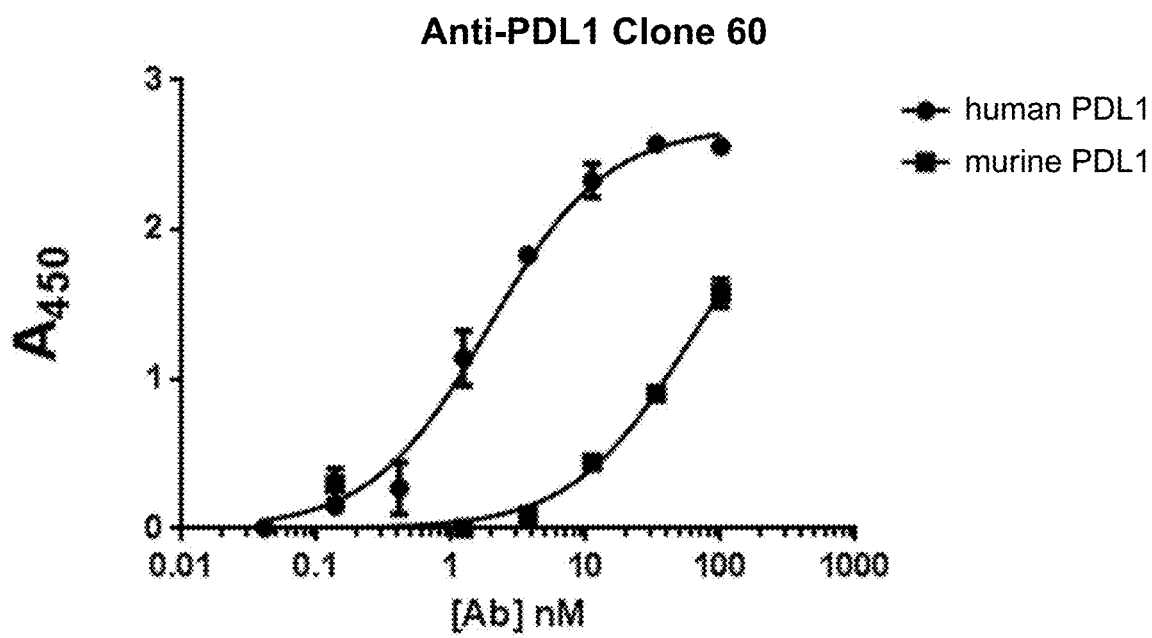
FIG. 3 is a graph depicting saturation binding data and demonstrates that anti-PDL1 clone 60:IgG binds to human PDL1 with a binding affinity ~1 nM, and to mouse PDL1 at 30 nM.

FIG. 3A shows that the fully human anti-PDL1 c60 IgG binds human and mouse PDL1, with affinity for human PDL1 of 1 nM and for mouse PDL1 of 30 nM. Briefly human PDL1-Fc or mouse PDL1-Fc (R & D Systems, Minneapolis, Minn.) was adsorbed to the wells of a 96-well ELISA plate. Purified anti-PDL1 c60 was applied to the plate and allowed to bind. Bound antibody was visualized with an anti-human IgG-HRP conjugate, Fab specific, (Sigma, St Louis, Mo.; Cat # A0293-1 ML) and developed with the chromogenic substrate TMB.

Example 3. Affinity Maturation of Anti-PDL1 Antibodies of the Embodiments

This Example demonstrates the isolation of antibodies of the embodiments with improved binding kinetics and manufacturability profile.

Anti-PDL1 antibodies were isolated from libraries with CDRs modified from anti-PDL1 c60. Such libraries were designed as shown in Tables 2 and 3. Four libraries of Fab-Phage, based on the sequence of anti-PDL1 c60, were constructed using degenerate synthetic DNA. Residues were either varied by randomization at each indicated nucleotide. In addition, within libraries 3 and 6, additional randomized residues were added to CDR3 of the heavy chain. Libraries were transfected into *E. coli* strain TG1 and phage were prepared following super-infection with M13KO7 (Invitrogen).

Three rounds of selection were performed for each library with increasing stringency. Three alternating rounds of selection were done by mixing biotinylated Human PDL1 or Biotinylated mouse PDL1 with phage that were blocked with 100 µg/mL pooled human IgG (huIgG, or hIgG) and 2% non-fat dried milk (NFDM) in Tris-buffered saline (TBS; 40 mM Tris, 129 mM NaCl, pH 7.4). Following incubation at room temperature Bio-PDL1 bound to phage were captured with streptavidin magnetic beads which were washed extensively at 37° C. and the remaining bound phage eluted with 100 mM triethanolamine (TEA) (Sigma, St. Louis, Mo.) and expanded through *E. coli* TG1. Selected Lc libraries were combined with Hc libraries and each subjected to an additional seven rounds of selection.

TABLE 2

CDR sequences for affinity maturation variable heavy chain libraries

| IMGT | ... | 32 | 33 | 34 | 39 | 40 | ... | 55 | 56 | 57 | 58 | 59 | 60 | 61 | 62 | 63 | 66 | 67 | ... | 107 | 108 | 109 | 110 | 111 | 112 | 113 | |
|---|---|---|---|---|---|---|---|---|---|---|---|---|---|---|---|---|---|---|---|---|---|---|---|---|---|---|---|
| VH3-23 germline | | S | Y | A | M | S | | A | I | S | G | S | G | G | S | T | Y | Y | | — | — | — | — | — | — | — | |
| | | | (SEQ ID NO 58) | | | | | | | | (SEQ ID NO: 159) | | | | | | | | | | | | | | | | |
| Clone 60 | | S | Y | A | M | S | | S | I | Y | S | T | G | G | A | T | A | Y | | S | S | A | G | F | D | Y |
| | | | (SEQ ID NO:158) | | | | | | | | (SEQ ID NO: 160) | | | | | | | | | | | (SEQ ID NO: 162) | | | | | |
| H2 | | | | | | | | x | | x | x | x | | | x | x | | x | | | | | | | | | 3.36E+07 |
| | | | | | | | | | | | | (SEQ ID NO:161) | | | | | | | | | | | | | | | |
| H3 walk | | | | | | | | | | | | | | | | | | | | (SEQ ID NO: 163) | x | x | | | | | 1.02E+04 |
| | | | | | | | | | | | | | | | | | | | (SEQ ID NO: 164) | x | | x | | | | |
| | | | | | | | | | | | | | | | | | | | (SEQ ID NO: 165) | | x | x | | | | |
| | | | | | | | | | | | | | | | | | | | (SEQ ID NO: 166) | x | | x | | | | |
| | | | | | | | | | | | | | | | | | | | (SEQ ID NO: 167) | x | | | x | | | |
| | | | | | | | | | | | | | | | | | | | (SEQ ID NO: 168) | | x | | x | | | |
| | | | | | | | | | | | | | | | | | | | (SEQ ID NO: 169) | x | | | | x | | |
| | | | | | | | | | | | | | | | | | | | (SEQ ID NO: 170) | | x | | | x | | |
| | | | | | | | | | | | | | | | | | | | (SEQ ID NO: 171) | | | x | | x | | |
| | | | | | | | | | | | | | | | | | | | (SEQ ID NO: 172) | | | | x | x | | |
| H3 insertions: 4xNNK between G110 and F111 (SEQ ID NO: 1203) | | | | | | | | | | | | | | | | | | | | (SEQ ID NO: 173) | | T(x)$_{1-4}$F | | | | | 1E+06 |

TABLE 3

CDR sequences for affinity maturation variable light chain libraries

| IMGT | ... | 27 | 28 | 29 | 30 | 31 | 32 | ... | 56 | 57 | 58 | 59 | ... | 104 | 105 | 106 | 107 | 108 | 109 | 110 | 111 | 112 | 113 | |
|---|---|---|---|---|---|---|---|---|---|---|---|---|---|---|---|---|---|---|---|---|---|---|---|---|
| Vk1-39 germline | | Q | S | I | S | S | Y | | A | A | S | S | | C | Q | Q | S | Y | S | T | P | P | | |
| | | | | (SEQ ID NO: 174) | | | | | | (SEQ ID NO: 175) | | | | | | | | (SEQ ID NO: 177) | | | | | | |
| Clone 60 | | Q | S | I | S | S | Y | | Y | A | S | T | | C | Q | Q | D | N | G | Y | P | S | T |
| | | | | (SEQ ID NO: 174) | | | | | | (SEQ ID NO: 176) | | | | | | | | (SEQ ID NO: 178) | | | | | | |
| L2 nnk + L3 walk | | | | | | | | | X | X | | | | (SEQ ID NO: 180) | | | | | X | X | | | | 1.26E+07 |
| | | | | | | | | | X | X | | | | (SEQ ID NO: 181) | | | | | | X | X | | | |
| | | | | | | | | | X | X | | | | (SEQ ID NO: 182) | | | | | | | X | X | | |
| | | | | | | | | | X | X | | | | (SEQ ID NO: 183) | | | | | | | | X | X | |
| | | | | | | | | | X | X | | | | (SEQ ID NO: 184) | | | | | | | | | X | X |
| | | | | | | | | | X | X | | | | (SEQ ID NO: 185) | | | | | X | | X | | | |

TABLE 3-continued

CDR sequences for affinity maturation variable light chain libraries

| IMGT | ... | 27 | 28 | 29 | 30 | 31 | 32 | ... | 56 | 57 | 58 | 59 | ... | 104 | 105 | 106 | 107 | 108 | 109 | 110 | 111 | 112 | 113 |
|---|---|---|---|---|---|---|---|---|---|---|---|---|---|---|---|---|---|---|---|---|---|---|---|
| | | | | | | | | | X | | X | | | (SEQ ID NO: 186) | | | X | | X | | | | |
| | | | | | | | | | X | | X | | | (SEQ ID NO: 187) | | | X | | | | X | | |
| | | | | | | | | | X | | X | | | (SEQ ID NO: 188) | | | | X | X | | | | |
| | | | | | | | | | X | | X | | | (SEQ ID NO: 189) | | | X | | | | X | | |
| | | | | | | | | | X | | X | | | (SEQ ID NO: 190) | | | | | X | | X | | |
| | | | | | | | | | X | | X | | | (SEQ ID NO: 183) | | | | | | X | X | | |

Figure 4A:
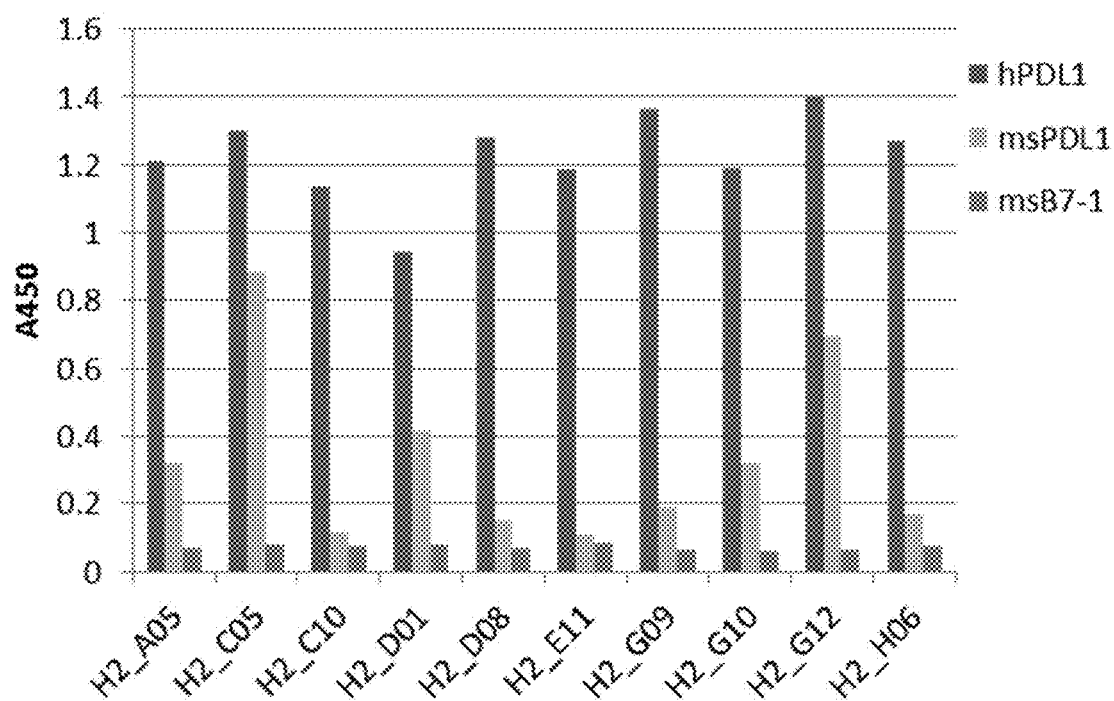
FIGS. 4A and 4B are a series of graphs depicting H2 specificity and cross reactivity (FIG. 4A) and H3W specificity and cross reactivity (FIG. 4B).
Figure 4B:
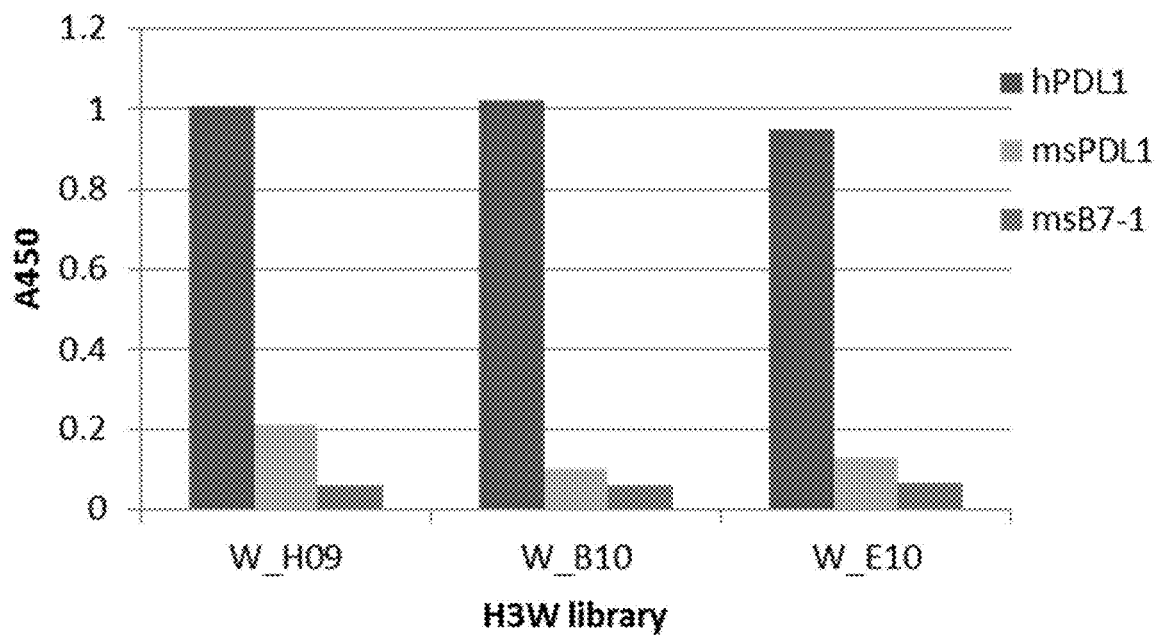

Forty seven (47) individual isolates were chosen from the final pool. Phage were derived from each isolate and assayed for binding to human PDL1-Fc, human B7-1-Fc and human CD28-Fc antigens (R&D Systems). Briefly, the antigens were adsorbed to the wells of a 96-well ELISA plate, each ligand on a separate plate. Phage were applied to correlative wells on each plate and allowed to bind. Bound phage were visualized with an anti-M13-HRP conjugate and developed with the chromogenic substrate TMB. Based on the results of the ELISA and DNA sequence, 6 unique clones with matured heavy variable CDR3 domains and 10 heavy variable CDR2 domains were chosen for further study. Thirteen phage clones, 10 CDR2 and 3 CDR3 were analyzed for their ability to bind mouse and human PDL1, and the results of a phage ELISA are shown in FIG. 4A and FIG. 4B. All phage clones bind human PDL1 but not B7-1, in addition, CDR2 clones C05 and G12 show strong binding to mouse PDL1 and CDR3 clone H9 showed weak binding to mouse PDL1. Table 4 lists the heavy variable domains encoded by the clones and SEQ ID NOs for the nucleic acid sequences and amino acid sequences of their respective heavy chains. The light variable domains for each are identical to that of c60 (SEQ ID NO 11 and 12).

```
                                          SEQ ID NO: 11
GACATCCAGATGACCCAGTCTCCATCCTCCCTGTCTGCATCTGTAGGAGA

CAGAGTCACCATCACTTGCCGGGCAAGTCAGAGCATTAGCAGCTATTTAA

ATTGGTATCAGCAGAAACCAGGGAAAGCCCCTAAGCTCCTGATCTATTAT

GCATCCACTTTGCAAAGTGGGGTCCCATCAAGGTTCAGTGGCAGTGGATC

TGGGACAGATTTCACTCTCACCATCAGCAGTCTGCAACCTGAAGATTTTG
```

```
                                          -continued
CAACTTACTACTGTCAACAGGATAATGGTTATCCTTCTACGTTCGGCCAA

GGGACCAAGGTGGAAATCAAACGG
```

```
                                          SEQ ID NO: 12
DIQMTQSPSSLSASVGDRVTITCRASQSISSYLNWYQQKPGKAPKLLIYY

ASTLQSGVPSRFSGSGSGTDFTLTISSLQPEDFATYYCQQDNGYPSTFGQ

GTKVEIKR
```

TABLE 4

Matured anti-PDL1 variable domains

| VH | Nucleic acid sequence | Amino acid sequence |
|---|---|---|
| PDL1 c1 | SEQ ID NO: 13 | SEQ ID NO: 14 |
| PDL1 d1 | SEQ ID NO: 15 | SEQ ID NO: 16 |
| PDL1 g7 | SEQ ID NO: 17 | SEQ ID NO: 18 |
| PDL1 h9 | SEQ ID NO: 19 | SEQ ID NO: 20 |
| PDL1 b10 | SEQ ID NO: 21 | SEQ ID NO: 22 |
| PDL1 E10 | SEQ ID NO: 23 | SEQ ID NO: 24 |
| PDL1 A05 | SEQ ID NO: 25 | SEQ ID NO: 26 |
| PDL1 C05 | SEQ ID NO: 27 | SEQ ID NO: 28 |
| PDL1 C10 | SEQ ID NO: 29 | SEQ ID NO: 30 |
| PDL1 D08 | SEQ ID NO: 31 | SEQ ID NO: 32 |
| PDL1 G09 | SEQ ID NO: 33 | SEQ ID NO: 34 |
| PDL1 G10 | SEQ ID NO: 35 | SEQ ID NO: 36 |
| PDL1 G12 | SEQ ID NO: 37 | SEQ ID NO: 38 |
| PDL1 E11 | SEQ ID NO: 39 | SEQ ID NO: 40 |
| PDL1 D01 | SEQ ID NO: 41 | SEQ ID NO: 42 |
| PDL1 H06 | SEQ ID NO: 43 | SEQ ID NO: 44 |

```
                                          SEQ ID NO: 13
GAGGTGCAGCTGTTGGAGTCTGGGGGAGGCTTGGTACAGCCTGGGGGGTCCCTGAGACTCTCCTGTGCAG

CCTCTGGATTCACCTTTAGCAGCTATGCCATGAGCTGGGTCCGCCAGGCTCCAGGGAAGGGGCTGGAGTG

GGTCTCAAGTATTTATTCTACTGGTGGTGCTACAGCTTACGCAGACTCCGTGAAGGGCCGGTTCACCATC

TCCAGAGACAATTCCAAGAACACGCTGTATCTGCAAATGAACAGCCTGAGAGCCGAGGACACGGCCGTAT

ATTACTGTGCGAAATCTTCTGCTGGTAGTCGGCCGGGTTTTGACTACTGGGGCCAGGGAACCCTGGTCAC

CGTCTCGAGC
```

SEQ ID NO: 14
EVQLLESGGGLVQPGGSLRLSCAASGFTFSSYAMSWVRQAPGKGLEWVSSIYSTGGATAYADSVKGRFTI
SRDNSKNTLYLQMNSLRAEDTAVYYCAKSSAGQSRPGFDYWGQGTLVTVSS

SEQ ID NO: 15
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTATTCTACTGGTGGTGCTACAGCTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAAATCTTCTGCTGGTTCGTGGCCGGGTTTTGACTACTGGGGCCAGGGAACCCTGGTCAC
CGTCTCGAGC

SEQ ID NO: 16
EVQLLESGGGLVQPGGSLRLSCAASGFTFSSYAMSWVRQAPGKGLEWVSSIYSTGGATAYADSVKGRFTI
SRDNSKNTLYLQMNSLRAEDTAVYYCAKSSAGQSWPGFDYWGQGTLVTVSS

SEQ ID NO: 17
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTATTCTACTGGTGGTGCTACAGCTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAAATCTTCTGCTGGTCAGTCGTTTCCGGGTTTTGACTACTGGGGCCAGGGAACCCTGGT
CACCGTCTCGAGC

SEQ ID NO: 18
EVQLLESGGGLVQPGGSLRLSCAASGFTFSSYAMSWVRQAPGKGLEWVSSIYSTGGATAYADSVKGRFTI
SRDNSKNTLYLQMNSLRAEDTAVYYCAKSSAGQSFPGFDYWGQGTLVTVSS

SEQ ID NO: 19
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTATTCTACTGGTGGTGCTACAGCTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAAATGGTCTGCTGCTTTTGACTACTGGGGCCAGGGAACCCTGGTCACCGTCTCGAGC

SEQ ID NO: 20
EVQLLESGGGLVQPGGSLRLSCAASGFTFSSYAMSWVRQAPGKGLEWVSSIYSTGGATAYADSVKGRFTI
SRDNSKNTLYLQMNSLRAEDTAVYYCAKWSAAFDYWGQGTLVTVSS

SEQ ID NO: 21
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTATTCTACTGGTGGTGCTACAGCTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAAATGGTCTGCTGCTTTTGACTACTGGGGCCAGGGAACCCTGGTCACCGTCTCGAGC

SEQ ID NO: 22
EVQLLESGGGLVQPGGSLRLSCAASGFTFSSYAMSWVRQAPGKGLEWVSSIYSTGGATAYADSVKGRFTI
SRDNSKNTLYLQMNSLRAEDTAVYYCAKWSAGYDWGQGTLVTVSS

SEQ ID NO: 23
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTATTCTACTGGTGGTGCTACAGCTTACGCAGACTCCGTGAAGGGCCGGTTCACCATC

```
TCCAGAGACAATTCCAAGAACACGCTGTATCTGCAAATGAACAGCCTGAGAGCCGAGGACACGGCCGTAT

ATTACTGTGCGAAATGGTCTAAGGGTTTTGACTACGGGGCCAGGGAACCCTGGTCACCGTCTCGAGC
```

SEQ ID NO: 24
```
EVQLLESGGGLVQPGGSLRLSCAASGFTFSSYAMSWVRQAPGKGLEWVSSIYSTGGATAYADSVKGRFTI

SRDNSKNTLYLQMNSLRAEDTAVYYCAKWSKGFDYWGQGTLVTVSS
```

SEQ ID NO: 25
```
GAGGTGCAGCTGTTGGAGTCTGGGGGAGGCTTGGTACAGCCTGGGGGGTCCCTGAGACTCTCCTGTGCAG

CCTCTGGATTCACCTTTAGCAGCTATGCCATGAGCTGGGTCCGCCAGGCTCCAGGGAAGGGGCTGGAGTG

GGTCTCAAGTATTTGGAAGTAGGGTATTGTGACAGTGAGCTTACGCAGACTCCGTGAAGGGCCGGTTCAC

CATCTCCAGAGACAATTCCAAGAACACGCTGTATCTGCAAATGAACAGCCTGAGAGCCGAGGACACGGCC

GTATATTACTGTGCGAAATCTTCTGCTGGTTTTGACTACGGGGCCAGGGAACCCTGGTCACCGTCTCGA

GC
```

SEQ ID NO: 26
```
EVQLLESGGGLVQPGGSLRLSCAASGFTFSSYAMSWVRQAPGKGLEWVSSIWKQGIVTVYDSVKGRFTIS

RDNSKNTLYLQMNSLRAEDTAVYYCAKSSAGFDYWGQGTLVTV
```

SEQ ID NO: 27
```
GAGGTGCAGCTGTTGGAGTCTGGGGGAGGCTTGGTACAGCCTGGGGGGTCCCTGAGACTCTCCTGTGCAG

CCTCTGGATTCACCTTTAGCAGCTATGCCATGAGCTGGGTCCGCCAGGCTCCAGGGAAGGGGCTGGAGTG

GGTCTCAAGTATTTGGCGGAATGGTATTGTTACAGTTAGCTTACGCAGACTCCGTGAAGGGCCGGTTCAC

CATCTCCAGAGACAATTCCAAGAACACGCTGTATCTGCAAATGAACAGCCTGAGAGCCGAGGACACGGCC

GTATATTACTGTGCGAAATCTTCTGCTGGTTTTGACTACGGGGCCAGGGAACCCTGGTCACCGTCTCGA

GC
```

SEQ ID NO: 28
```
EVQLLESGGGLVQPGGSLRLSCAASGFTFSSYAMSWVRQAPGKGLEWVSSIWRNGIVTVYDSVKGRFTIS

RDNSKNTLYLQMNSLRAEDTAVYYCAKSSAGFDYWGQGTLVTVSS
```

SEQ ID NO: 29
```
GAGGTGCAGCTGTTGGAGTCTGGGGGAGGCTTGGTACAGCCTGGGGGGTCCCTGAGACTCTCCTGTGCAG

CCTCTGGATTCACCTTTAGCAGCTATGCCATGAGCTGGGTCCGCCAGGCTCCAGGGAAGGGGCTGGAGTG

GGTCTCAGATATTTGGAAGTAGGGTATGGTTACAGTGAGCTTACGCAGACTCCGTGAAGGGCCGGTTCAC

CATCTCCAGAGACAATTCCAAGAACACGCTGTATCTGCAAATGAACAGCCTGAGAGCCGAGGACACGGCC

GTATATTACTGTGCGAAATCTTCTGCTGGTTTTGACTACGGGGCCAGGGAACCCTGGTCACCGTCTCGA

GC
```

SEQ ID NO: 30
```
EVQLLESGGGLVQPGGSLRLSCAASGFTFSSYAMSWVRQAPGKGLEWVSDIWKQGMVTVYDSVKGRFTIS

RDNSKNTLYLQMNSLRAEDTAVYYCAKSSAGFDYWGQGTLVTVSS
```

SEQ ID NO: 31
```
GAGGTGCAGCTGTTGGAGTCTGGGGGAGGCTTGGTACAGCCTGGGGGGTCCCTGAGACTCTCCTGTGCAG

CCTCTGGATTCACCTTTAGCAGCTATGCCATGAGCTGGGTCCGCCAGGCTCCAGGGAAGGGGCTGGAGTG

GGTCTCATCGATTTGGAGGTAGGGTCTGGCGACAGCGAGCTTACGCAGACTCCGTGAAGGGCCGGTTCAC

CATCTCCAGAGACAATTCCAAGAACACGCTGTATCTGCAAATGAACAGCCTGAGAGCCGAGGACACGGCC

GTATATTACTGTGCGAAATCTTCTGCTGGTTTTGACTACGGGGCCAGGGAACCCTGGTCACCGTCTCGA

GC
```

SEQ ID NO: 32
```
EVQLLESGGGLVQPGGSLRLSCAASGFTFSSYAMSWVRQAPGKGLEWVSSIWRQGLATAYDSVKGRFTIS

RDNSKNTLYLQMNSLRAEDTAVYYCAKSSAGFDYWGQGTLVTVSS
```

SEQ ID NO: 33
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAGAGATTGTGGCTACTGGTATTTTGACAAGTAGCTTACGCAGACTCCGTGAAGGGCCGGTTCAC
CATCTCCAGAGACAATTCCAAGAACACGCTGTATCTGCAAATGAACAGCCTGAGAGCCGAGGACACGGCC
GTATATTACTGTGCGAAATCTTCTGCTGGTTTTGACTACGGGGCCAGGGAACCCTGGTCACCGTCTCGA
GC

SEQ ID NO: 34
EVQLLESGGGLVQPGGSLRLSCAASGFTFSSYAMSWVRQAPGKGLEWVSEIVATGILTSYDSVKGRFTIS
RDNSKNTLYLQMNSLRAEDTAVYYCAKSSAGFDYWGQGTLVTVSS

SEQ ID NO: 35
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCATCGATTGGTCGGTAGGGTTTGATTACAGTTAGCTTACGCAGACTCCGTGAAGGGCCGGTTCAC
CATCTCCAGAGACAATTCCAAGAACACGCTGTATCTGCAAATGAACAGCCTGAGAGCCGAGGACACGGCC
GTATATTACTGTGCGAAATCTTCTGCTGGTTTTGACTACGGGGCCAGGGAACCCTGGTCACCGTCTCGA
GC

SEQ ID NO: 36
EVQLLESGGGLVQPGGSLRLSCAASGFTFSSYAMSWVRQAPGKGLEWVSSIGRQGLITVYDSVKGRFTIS
RDNSKNTLYLQMNSLRAEDTAVYYCAKSSAGFDYWGQGTLVTVSS

SEQ ID NO: 37
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCATCTATTTGGTATTAGGGTCTGGTGACAGTTAGCTTACGCAGACTCCGTGAAGGGCCGGTTCAC
CATCTCCAGAGACAATTCCAAGAACACGCTGTATCTGCAAATGAACAGCCTGAGAGCCGAGGACACGGCC
GTATATTACTGTGCGAAATCTTCTGCTGGTTTTGACTACGGGGCCAGGGAACCCTGGTCACCGTCTCGA
GC

SEQ ID NO: 38
EVQLLESGGGLVQPGGSLRLSCAASGFTFSSYAMSWVRQAPGKGLEWVSSIWYQGLVTVYDSVKGRFTIS
RDNSKNTLYLQMNSLRAEDTAVYYCAKSSAGFDYWGQGTLVTVSS

SEQ ID NO: 39
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAGATATTTGGAAGTAGGGTTTTGCTACAGCGAGCTTACGCAGACTCCGTGAAGGGCCGGTTCAC
CATCTCCAGAGACAATTCCAAGAACACGCTGTATCTGCAAATGAACAGCCTGAGAGCCGAGGACACGGCC
GTATATTACTGTGCGAAATCTTCTGCTGGTTTTGACTACGGGGCCAGGGAACCCTGGTCACCGTCTCGA
GC

SEQ ID NO: 40
EVQLLESGGGLVQPGGSLRLSCAASGFTFSSYAMSWVRQAPGKGLEWVSDIWKQGFATADSVKGRFTISR
DNSKNTLYLQMNSLRAEDTAVYYCAKSSAGFDYWGQGTLVTVSS

SEQ ID NO: 41
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTGGAAGTAGGGTATTGTGACAGTGAGCTTACGCAGACTCCGTGAAGGGCCGGTTCAC

-continued

```
CATCTCCAGAGACAATTCCAAGAACACGCTGTATCTGCAAATGAACAGCCTGAGAGCCGAGGACACGGCC

GTATATTACTGTGCGAAATCTTCTGCTGGTTTTGACTACTGGGGCCAGGGAACCCTGGTCACCGTCTCGA

GC
```

SEQ ID NO: 42
```
EVQLLESGGGLVQPGGSLRLSCAASGFTFSSYAMSWVRQAPGKGLEWVSSIWKQGIVTVYDSVKGRFTIS

RDNSKNTLYLQMNSLRAEDTAVYYCAKSSAGFDYWGQGTLVTVSS
```

SEQ ID NO: 43
```
GAGGTGCAGCTGTTGGAGTCTGGGGGAGGCTTGGTACAGCCTGGGGGGTCCCTGAGACTCTCCTGTGCAG

CCTCTGGATTCACCTTTAGCAGCTATGCCATGAGCTGGGTCCGCCAGGCTCCAGGGAAGGGGCTGGAGTG

GGTCTCATCGATTTGGAGGTAGGGTCTGGCGACAGCGAGCTTACGCAGACTCCGTGAAGGGCCGGTTCAC

CATCTCCAGAGACAATTCCAAGAACACGCTGTATCTGCAAATGAACAGCCTGAGAGCCGAGGACACGGCC

GTATATTACTGTGCGAAATCTTCTGCTGGTTTTGACTACTGGGGCCAGGGAACCCTGGTCACCGTCTCGA

GC
```

SEQ ID NO: 44
```
EVQLLESGGGLVQPGGSLRLSCAASGFTFSSYAMSWVRQAPGKGLEWVSSIWRQGLATAYDSVKGRFTIS

RDNSKNTLYLQMNSLRAEDTAVYYCAKSSAGFDYWGQGTLVTVSS
```

Example 4. Isolation and Testing of Affinity Matured Anti-PDL1 Antibodies of the Embodiments This Example demonstrates that matured PDL1 Fab-phage that bind human and mouse PDL1 can be converted into fully human IgG antibodies that retain human and show enhanced mouse PDL1 binding.

Production of fully human IgGs comprising the variable domains of the matured clones was accomplished using techniques similar to those described in PCT Publication No. WO 2010/081173. DNA encoding the variable domains of anti-PDL1 Fab-Phage clones C1, D1, G7, C05, G12 and combinations of heavy variable CDR3 domains of anti-PDL1 Fab-Phage clones C05 or G12 with anti-PDL1 Fab-Phage clones heavy variable CDR2 domains of B10, E11) or H9 were cloned into expression vectors for the expression of fully human IgGs. The light variable domains for each are identical to that of c60 (SEQ ID NO: 10). Light chain (Lc) variable domains were amplified from the Fab templates. Vector (LcpOP (modified from pCDNA3, Invitrogen, Carlsbad, Calif.)) and amplified DNA were cut with BsiWI and EcoRI overnight, combined by ligation and transformed into E. coli MC1061 cells. Heavy chain (Hc) variable domains were amplified from Fab templates. Fully human IgGs anti-PDL1 antibodies were expressed from transiently transfected HEK-293 cells and purified from the culture supernatant by Protein A chromatography.

Figure 5A:
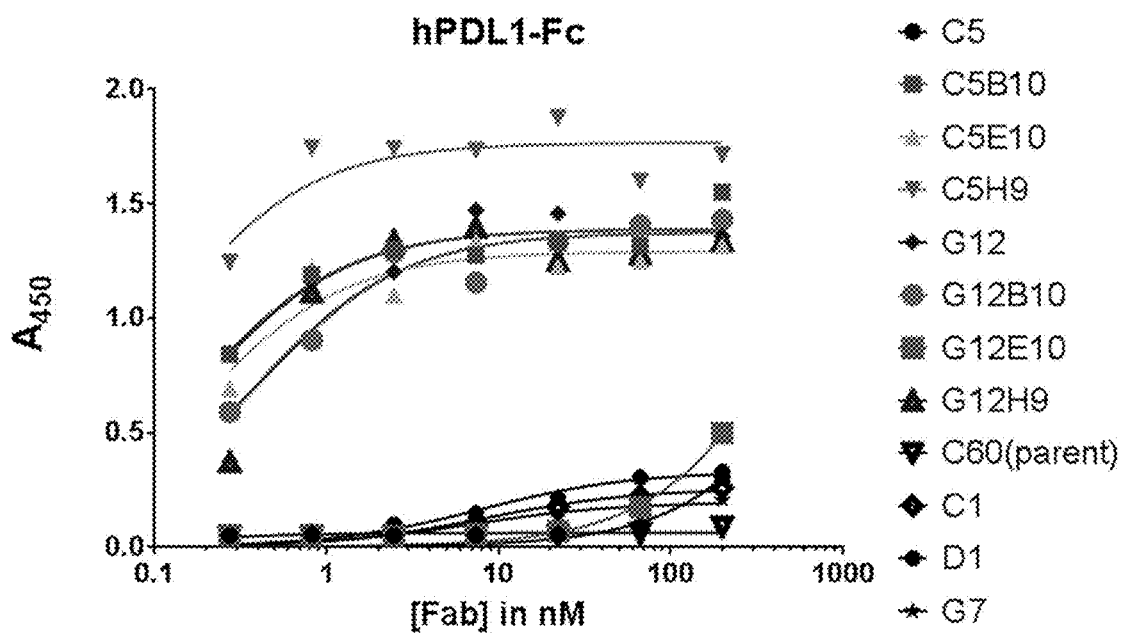
FIGS. 5A and 5B are a series of graphs depicting that combining the matured heavy variable CDR3 domains with the heavy variable CDR2 domains results in antibodies with enhanced affinity towards human PDL1.
Figure 5B:
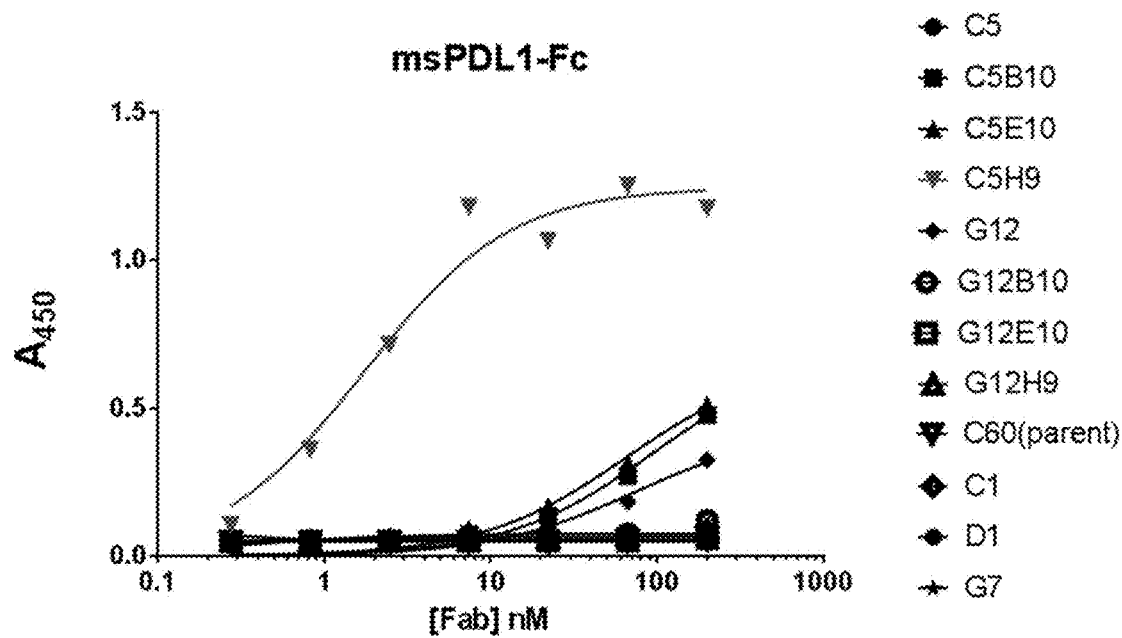

The affinity matured anti-PDL1 antibodies were analyzed for their ability to bind human and mouse PDL1. Briefly human PDL1-Fc or mouse PDL1-Fc (R & D Systems, Minneapolis, Minn.) was adsorbed to the wells of a 96-well ELISA plate. Purified anti-PDL1 antibodies were applied to the plate and allowed to bind. Bound antibody was visualized with an anti-human IgG-HRP conjugate, Fab specific, (Sigma, St Louis, Mo.; Cat # A0293-1 ML) and developed with the chromogenic substrate TMB. FIGS. 5A and B show that combining the matured heavy variable CDR3 domains with the heavy variable CDR2 domains results in antibodies with enhanced affinity towards human PDL1. In addition, the combination of the matured heavy variable CDR2 domain C05 with the heavy variable CD3 domain H9 results in an antibody with high affinity for both human and mouse PDL1. Table 5 provides the SEQ ID NOs for the nucleic acid sequences and amino acids sequences of the respective variable heavy chains.

Figure 6A:
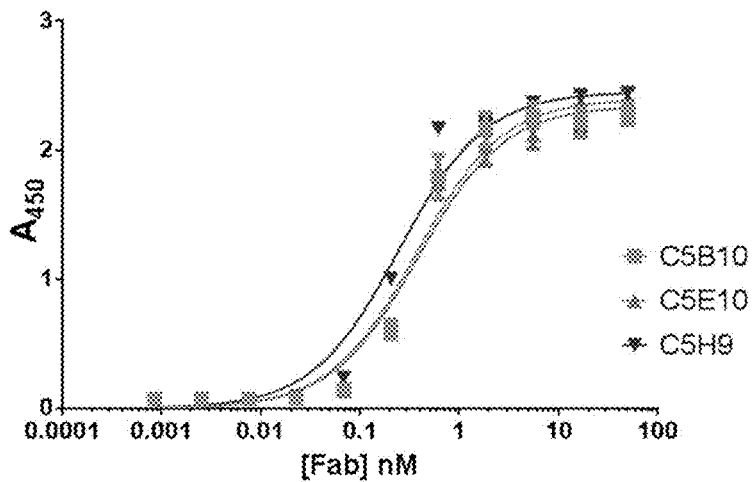
FIGS. 6A, 6B, 6C, and 6D are a series of graphs depicting that anti-PDL1 antibody C5H9 binds to human and mouse PDL1 with near equal affinity and that anti-PDL1 antibodies C5B10 and C5E10 only bind human PDL1.
Figure 6B:
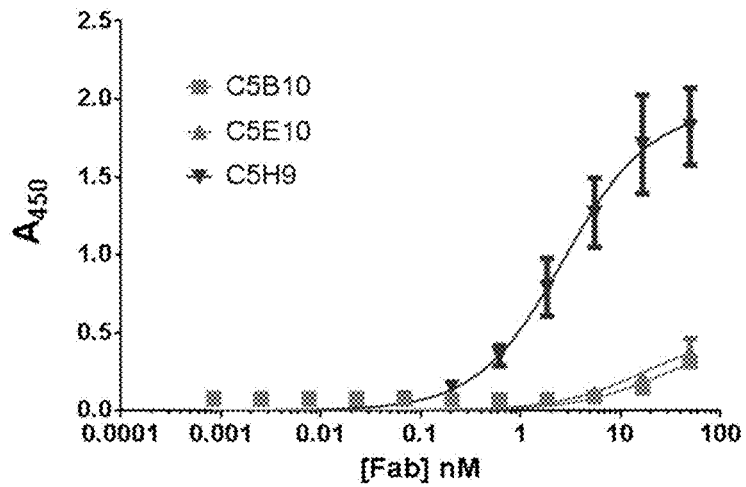
Figure 6C:
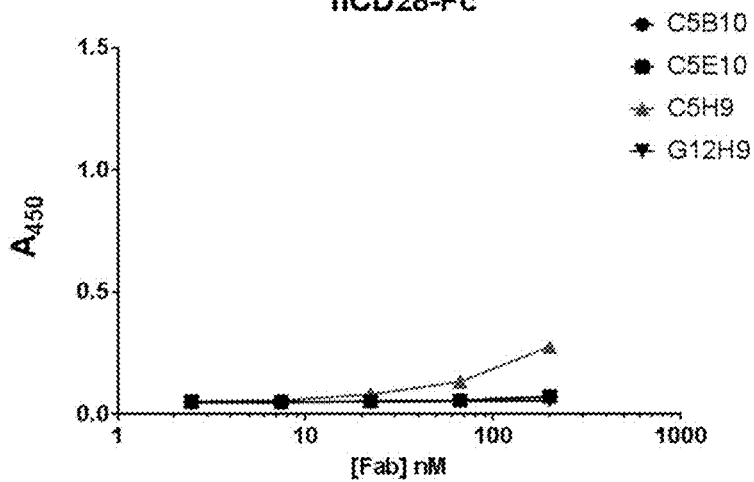
Figure 6D:
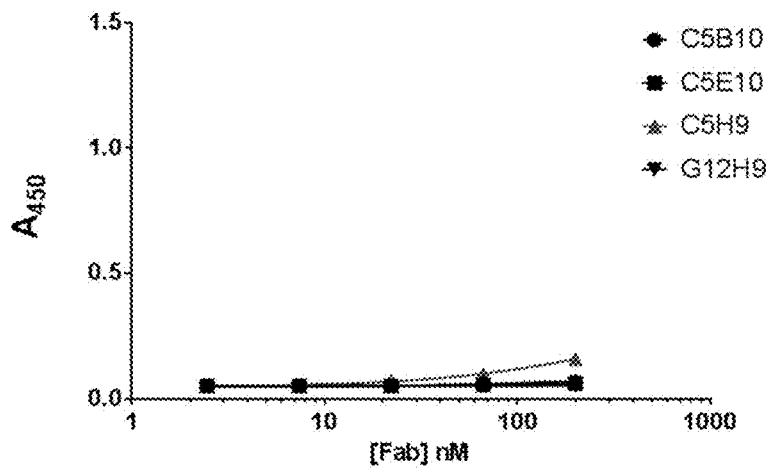
Figure 7:
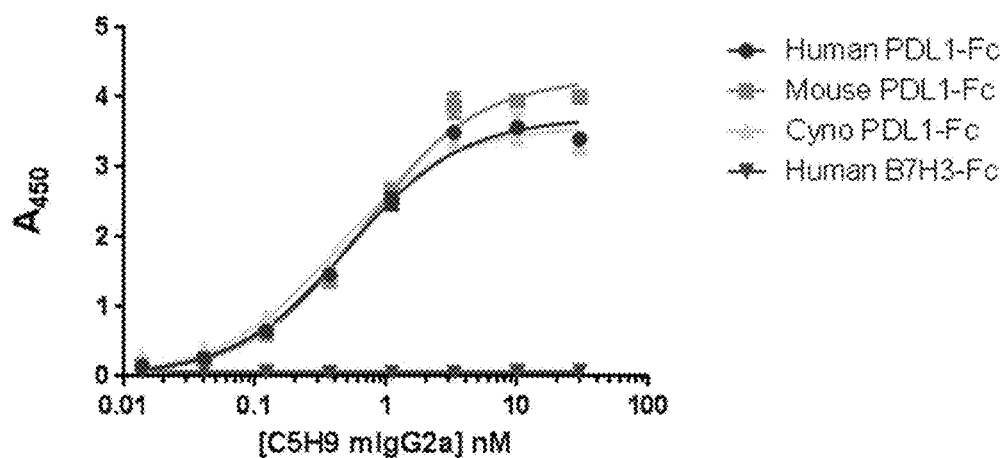
FIG. 7 is a graph depicting the ability of anti-PDL1 antibody C5H9 to bind with high and equal affinity to human, mouse and cyno PDL1.

The anti-PDL1 antibodies C5H9, C5B10 and C5E10 were further characterized for their species specificity towards binding to PDL1 and other closely related proteins. Briefly human PDL1-Fc, mouse PDL1-Fc (R & D Systems, Minneapolis, Minn.) or cynomolgus monkey (cyno) PDL1-Fc (Sino biological) were adsorbed to the wells of a 96-well ELISA plate. Purified anti-PDL1 antibodies were applied to the plate and allowed to bind. Bound antibody was visualized with an anti-human IgG-HRP conjugate, Fab specific, (Sigma, St Louis, Mo.; Cat # A0293-1 ML) and developed with the chromogenic substrate TMB. FIGS. 6A and 6B show that C5H9 binds to human and mouse PDL1 with near equal affinity and C5B10 and C5E10 only bind human PDL1. None of the antibodies tested bind to either human B7-1 (FIG. 6D) or human CD28 (FIG. 6C), two closely related proteins. FIG. 7A shows that anti-PDL1 antibody C5H9 binds with high and equal affinity to human, mouse and cyno PDL1, but not to human B7H3 (also referred to as B7-H3) (R&D Systems, Minneapolis, Minn.).

TABLE 5

Variable heavy domains of PDL1 antibodies of the embodiments

| VH | Nucleic acid sequence | Amino acid sequence |
|---|---|---|
| PDL1 C5H9 | SEQ ID NO: 45 | SEQ ID NO: 46 |
| PDL1 C5B10 | SEQ ID NO: 47 | SEQ ID NO: 48 |
| PDL1 C5E01 | SEQ ID NO: 49 | SEQ ID NO: 50 |
| PDL1 G12H9 | SEQ ID NO: 51 | SEQ ID NO: 52 |
| PDL1 G12B10 | SEQ ID NO: 53 | SEQ ID NO: 54 |
| PDL1 G12E10 | SEQ ID NO: 55 | SEQ ID NO: 56 |

SEQ ID NO: 45
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTGGCGGAATGGTATTGTTACAGTTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAAATGGTCTGCTGCTTTTGACTACTGGGGCCAGGGAACCCTGGTCACCGTCTCGAGC

SEQ ID NO: 46
EVQLLESGGGLVQPGGSLRLSCAASGFTFSSYAMSWVRQAPGKGLEWVSSIWRNGIVTVYADSVKGRFTI
SRDNSKNTLYLQMNSLRAEDTAVYYCAKWSAAFDYWGQGTLVTVSS

SEQ ID NO: 47
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTGGCGGAATGGTATTGTTACAGTTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAAATGGTCTGCTGGTTATGACTACTGGGGCCAGGGAACCCTGGTCACCGTCTCGAGC

SEQ ID NO: 48
EVQLLESGGGLVQPGGSLRLSCAASGFTFSSYAMSWVRQAPGKGLEWVSSIWRNGIVTVYADSVKGRFTI
SRDNSKNTLYLQMNSLRAEDTAVYYCAKWSAGYDYWGQGTLVTVSS

SEQ ID NO: 49
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTGGCGGAATGGTATTGTTACAGTTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAAATGGTCTAAGGGTTTTGACTACTGGGGCCAGGGAACCCTGGTCACCGTCTCGAGC

SEQ ID NO: 50
EVQLLESGGGLVQPGGSLRLSCAASGFTFSSYAMSWVRQAPGKGLEWVSSIWRNGIVTVYADSVKGRFTI
SRDNSKNTLYLQMNSLRAEDTAVYYCAKWSKGFDYWGQGTLVTVSS

SEQ ID NO: 51
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCATCTATTTGGTATCAGGGTCTGGTGACAGTTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAPATGGTCTGCTGCTTTTGACTACTGGGGCCAGGGAPCCCTGGTCACCGTCTCGAGC

SEQ ID NO: 52
EVQLLESGGGLVQPGGSLRLSCAASGFTFSSYAMSWVRQAPGKGLEWVSSIWYQGLVTVYADSVKGRFTI
SRDNSKNTLYLQMNSLRAEDTAVYYCAKWSAAFDYWGQGTLVTVSS

SEQ ID NO: 53
GAGGTGCAGCTGTTGGAGTCTGGGGGAGGCTTGGTACAGCCTGGGGGGTCCCTGAGACTCTCCTGTGCAG
CCTCTGGATTCACCTTTAGCAGCTATGCCATGAGCTGGGTCCGCCAGGCTCCAGGGAAGGGGCTGGAGTG
GGTCTCAAGTATTTGGCGGAATGGTATTGTTACAGTTTACGCAGACTCCGTGAAGGGCCGGTTCACCATC
TCCAGAGACAATTCCAAGAACACGCTGTATCTGCAAATGAACAGCCTGAGAGCCGAGGACACGGCCGTAT
ATTACTGTGCGAAATGGTCTGCTGGTTATGACTACTGGGGCCAGGGAACCCTGGTCACCGTCTCGAGC

SEQ ID NO: 54
EVQLLESGGGLVQPGGSLRLSCAASGFTFSSYAMSWVRQAPGKGLEWVSSIWYQGLVTVYADSVKGRFTI
SRDNSKNTLYLQMNSLRAEDTAVYYCAKWSAGYDYWGQGTLVTVSS

SEQ ID NO: 55
GAGGTGCAGCTGTTGGAGTCTGGGGGAGGCTTGGTACAGCCTGGGGGGTCCCTGAGACTCTCCTGTGCAG

CCTCTGGATTCACCTTTAGCAGCTATGCCATGAGCTGGGTCCGCCAGGCTCCAGGGAAGGGGCTGGAGTG

GGTCTCAAGTATTTGGCGGAATGGTATTGTTACAGTTTACGCAGACTCCGTGAAGGGCCGGTTCACCATC

TCCAGAGACAATTCCAAGAACACGCTGTATCTGCAAATGAACAGCCTGAGAGCCGAGGACACGGCCGTAT

ATTACTGTGCGAAATGGTCTAAGGGTTTTGACTACTGGGGCCAGGGAACCCTGGTCACCGTCTCGAGC

SEQ ID NO: 56
EVQLLESGGGLVQPGGSLRLSCAASGFTFSSYAMSWVRQAPGKGLEWVSSIWYQGLVTVYADSVKGRFTI

SRDNSKNTLYLQMNSLRAEDTAVYYCAKWSKGFDYWGQGTLVTVSS

Example 5. Germline Revisions in Anti-PDL1 Antibody C5H9 Light Variable Domain Enhances Manufacturability and Reduces Potential Immunogenicity This example describes an additional anti-PDL1 antibody embodiment that exhibits reduced predicted immunogenicity, reduced aggregation, and improved expression.

In silico immunogenicity prediction, using ProPred revealed a strong potential epitope in CDR2 of the light variable domain of C5H9; anti-PDL1 antibody C5H9, also referred to herein as C5H9, comprises a light chain comprising SEQ ID NO: 12 and a heavy chain comprising SEQ ID NO: 46. Alignment of the light variable domain of C5H9 with human germline antibodies revealed two amino acids in CDR2 that when reverted to germline eliminated the predicted epitope. The residues are underlined and in bold text in the sequence shown below in SEQ ID NO: 12.

Furthermore, framework 4 of the C5H9 light chain was modified as indicated with bold italics in SEQ ID NO: 58 substituting glycine (G) for glutamine (Q) in the J region. This modification was aimed at increasing the flexibility of the junction between variable and constant regions, potentially reducing the tendency of C5H9 to form aggregates. The resultant DNA and amino acid sequences are described by SEQ ID NO: 57 and SEQ ID NO: 58, respectively. The resultant anti-PDL1 antibody, referred to herein as anti-PDL1 antibody C5H9v2, also referred to herein as C5H9v2, comprises a light chain comprising SEQ ID NO: 58 and a heavy chain comprising SEQ ID NO: 46.

SEQ ID NO: 12
DIQMTQSPSSLSASVGDRVTITCRASQSISSYLNWYQQKPGKAPKLLIYY

ASTLQSGVPSRFSGSGSGTDFTLTISSLQPEDFATYYCQQDNGYPSTFGQ

GTKVEIKR

SEQ ID NO: 57
GATATTCAGATGACCCAGAGCCCGAGCAGCCTGAGCGCGAGCGTGGGCGA

TCGCGTGACCATTACCTGCCGCGCGAGCCAGAGCATTAGCAGCTATCTGA

ACTGGTATCAGCAGAAACCGGGCAAAGCGCCGAAACTGCTGATTTATGCG

GCGAGCAGCCTGCAGAGCGGCGTGCCGAGCCGCTTTAGCGGCAGCGGCAG

CGGCACCGATTTTACCCTGACCATTAGCAGCCTGCAGCCGGAAGATTTTG

CGACCTATTATTGCCAGCAGGATAACGGCTATCCGAGCACCTTTGGCGGC

GGCACCAAAGTGGAAATTAAACGC

SEQ ID NO: 58
DIQMTQSPSSLSASVGDRVTITCRASQSISSYLNWYQQKPGKAPKLLIYA

ASSLQSGVPSRFSGSGSGTDFTLTISSLQPEDFATYYCQQDNGYPSTFG

*G*GTKVEIKR

Figure 8A:
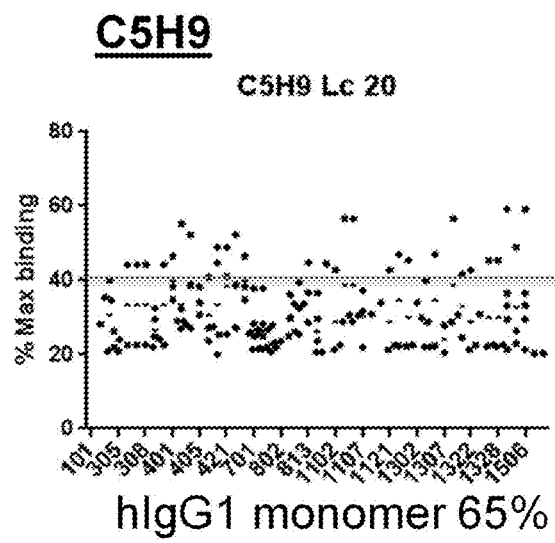
FIGS. 8A and 8B are a series of graphs depicting that anti-PDL1 antibody C5H9v2 has lower immunogenicity potential and enhanced manufacturability. These graphs demonstrate decreased predicted immunogenicity, increased expression levels (3×), and increased monomer percentage in human IgG1 format.
Figure 8A:
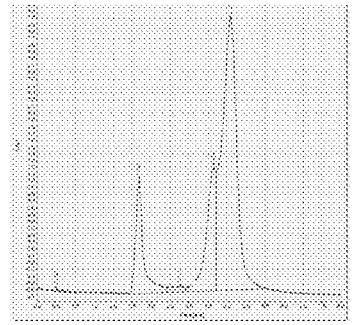
Figure 8B:
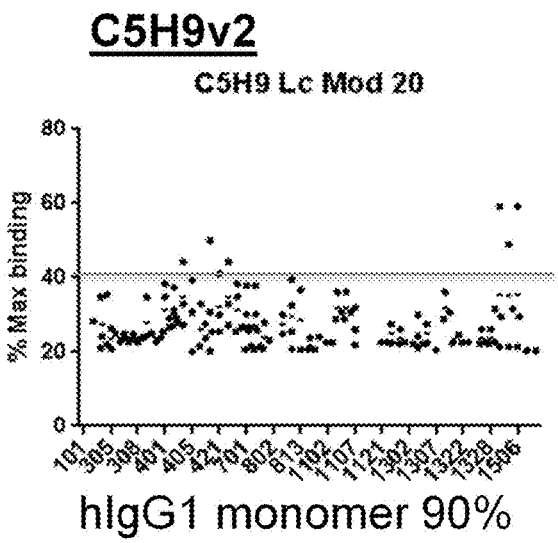
Figure 8B:
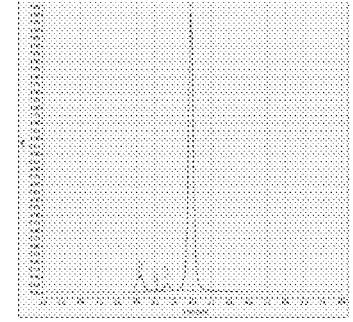

FIGS. 8A and 8B show that germline revisions described in SEQ ID NO: 58 reduces the predicted immunogenicity (top panel) and aggregation potential, and increases the expression level by three fold.

Example 6. In Vitro Characterization of Anti-PDL1 Antibodies C5119 and C5H9v2

This Example demonstrates the binding specificities and biological activities of anti-PDL1 antibodies of the disclosure.

Production of fully human IgGs comprising the variable domains of the matured clones was accomplished using techniques similar to those described in PCT Publication No. WO 2010/081173. DNA encoding the heavy variable domains of anti-PDL1 antibody C5H9 (nucleic acid SEQ ID NO: 45; amino acid SEQ ID NO: 46) were amplified and cloned into vectors for the expression of fully human IgGs. DNA encoding the light variable domains of anti-PDL1 antibody C5H9 (nucleic acid SEQ ID NO: 11; amino acid SEQ ID NO: 12) were amplified and cloned into vectors for the expression of fully human IgGs. Similarly, DNA encoding the heavy variable domains of anti-PDL1 antibody C5H9 (nucleic acid SEQ ID NO: 45; amino acid SEQ ID NO: 46) were amplified and cloned into vectors for the expression of chimeric mouse IgG2as. DNA encoding the light variable domains of anti-PDL1 antibody C5H9v2 (nucleic acid SEQ ID NO: 57; amino acid SEQ ID NO: 58) were amplified and cloned into vectors for the expression of chimeric mouse IgG2as. Fully human IgGs or chimeric mouse IgG2a anti-PDL1 antibodies were expressed from transiently transfected HEK-293 cells and purified from the culture supernatant by Protein A chromatography. Anti-PDL1 IgG antibody C5H9 comprises a heavy chain comprising a heavy variable domain comprising SEQ ID NO: 46 and a light chain comprising a light variable domain comprising SEQ ID NO: 12. Anti-PDL1 IgG antibody C5H9v2 comprises a heavy chain comprising a heavy variable domain comprising SEQ ID NO: 46 and a light chain comprising a light variable domain comprising SEQ ID NO: 58.

Figure 9A:
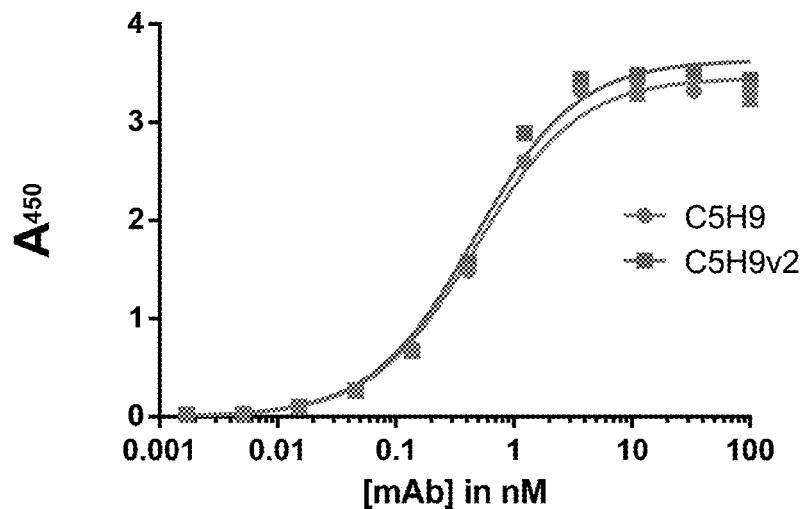
FIGS. 9A, 9B, and 9C are a series of graphs depicting ability of anti-PDL1 antibody C5H9v2 to bind with high affinity to (A) mouse, (B) cyno, and (C) human PDL1.
Figure 9B:
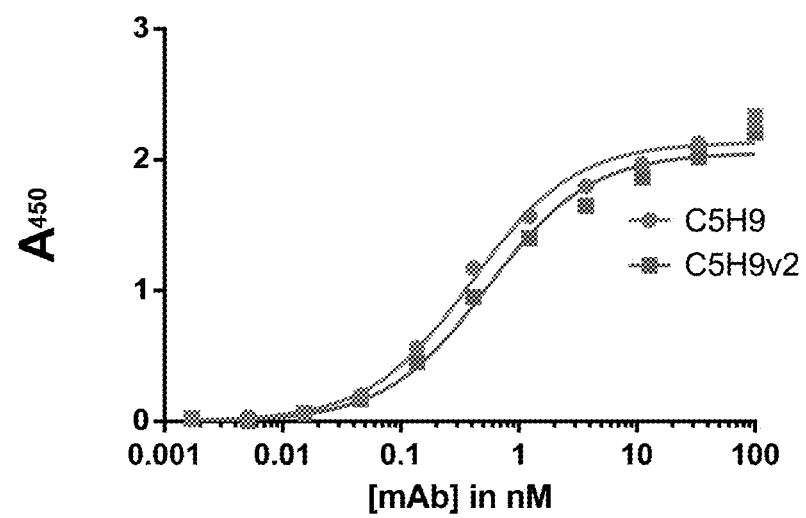
Figure 9C:
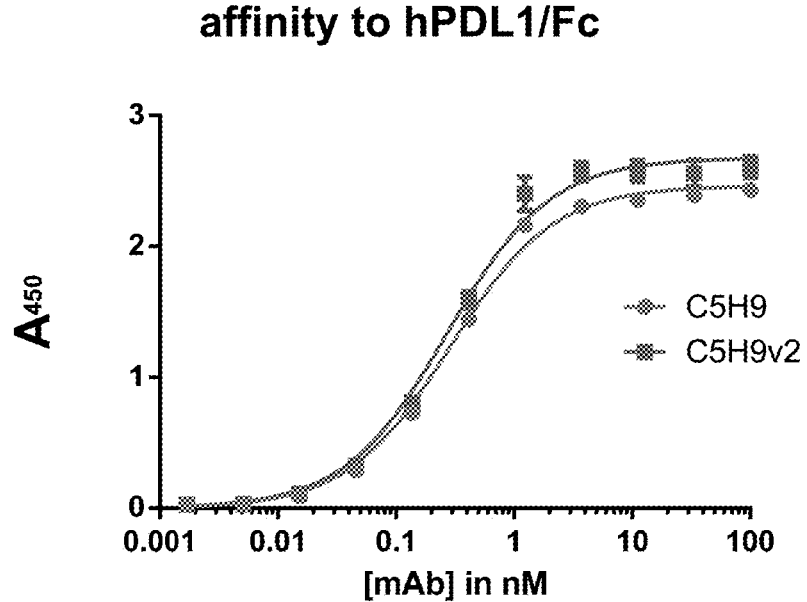

Anti-PDL1 antibody C5H9v2 was characterized for species specific binding to PDL1 and whether that antibody would bind a panel of human proteins. Briefly human PDL1-Fc, mouse PDL1-Fc (R & D Systems, Minneapolis, Minn.) or cynomolgus monkey (cyno) PDL1-Fc (Sino biological) was adsorbed to the wells of a 96-well ELISA plate. Purified anti-PDL1 antibodies C5H9 and C5H9v2 were applied to the plate and allowed to bind. Bound antibody was visualized with an anti-human IgG-HRP conjugate, Fab specific, (Sigma, St Louis, Mo.; Cat # A0293-1 ML) and developed with the chromogenic substrate TMB. FIGS. 9A to C show that both anti-PDL1 antibodies C5H9 and C5H9v2 bind human, mouse and cyno PDL1 with near equal affinity. $EC_{50}$ values for anti-PDL1 antibody C5H9v2 to human, cyno, rat and mouse PDL1 were also similar: 0.25 nM, 0.28 nM, 0.31 nM, and 0.30 nM, respectively.

Figure 10:
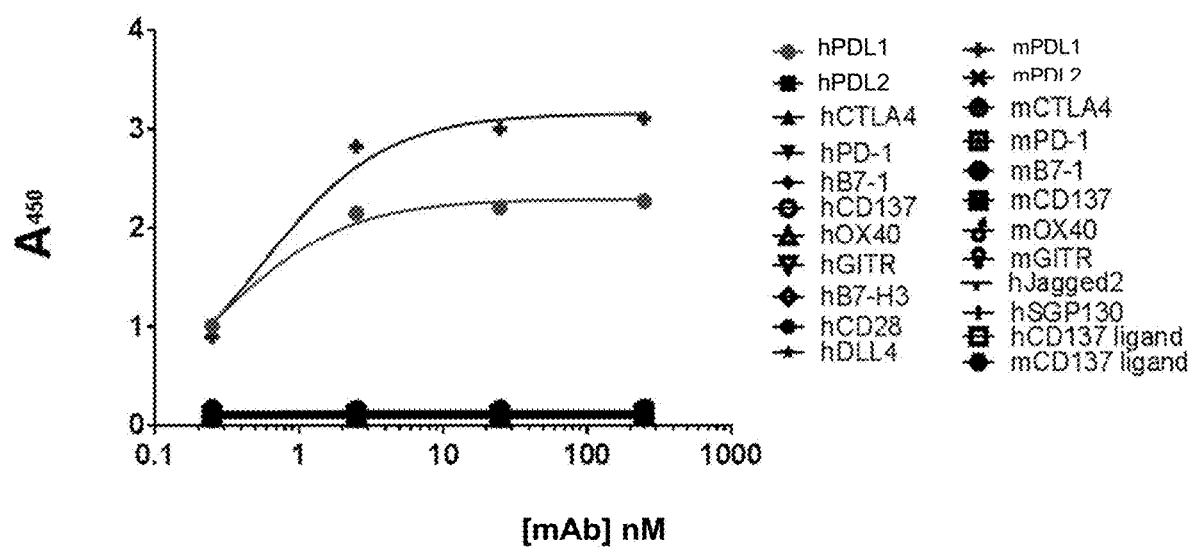
FIG. 10 is a graph depicting C5H9v2 specificity for a panel of human and mouse proteins.

In a similar experiment the binding of anti-PDL1 antibody C5H9 was evaluated for binding to a panel of human and mouse proteins. Briefly, each protein, listed in FIG. 10A, was absorbed to the wells of an ELISA plate. Purified anti-PDL1 antibodies C5H9 and C5H9v2 were applied to the plate and allowed to bind. Bound antibody was visualized with an anti-human IgG-HRP conjugate, Fab specific, (Sigma, St Louis, Mo.; Cat # A0293-1 ML) and developed with the chromogenic substrate TMB. Anti-PDL1 antibody C5H9v2 binds only to human and mouse PDL1 demonstrating specificity toward PDL1.

Figure 11:
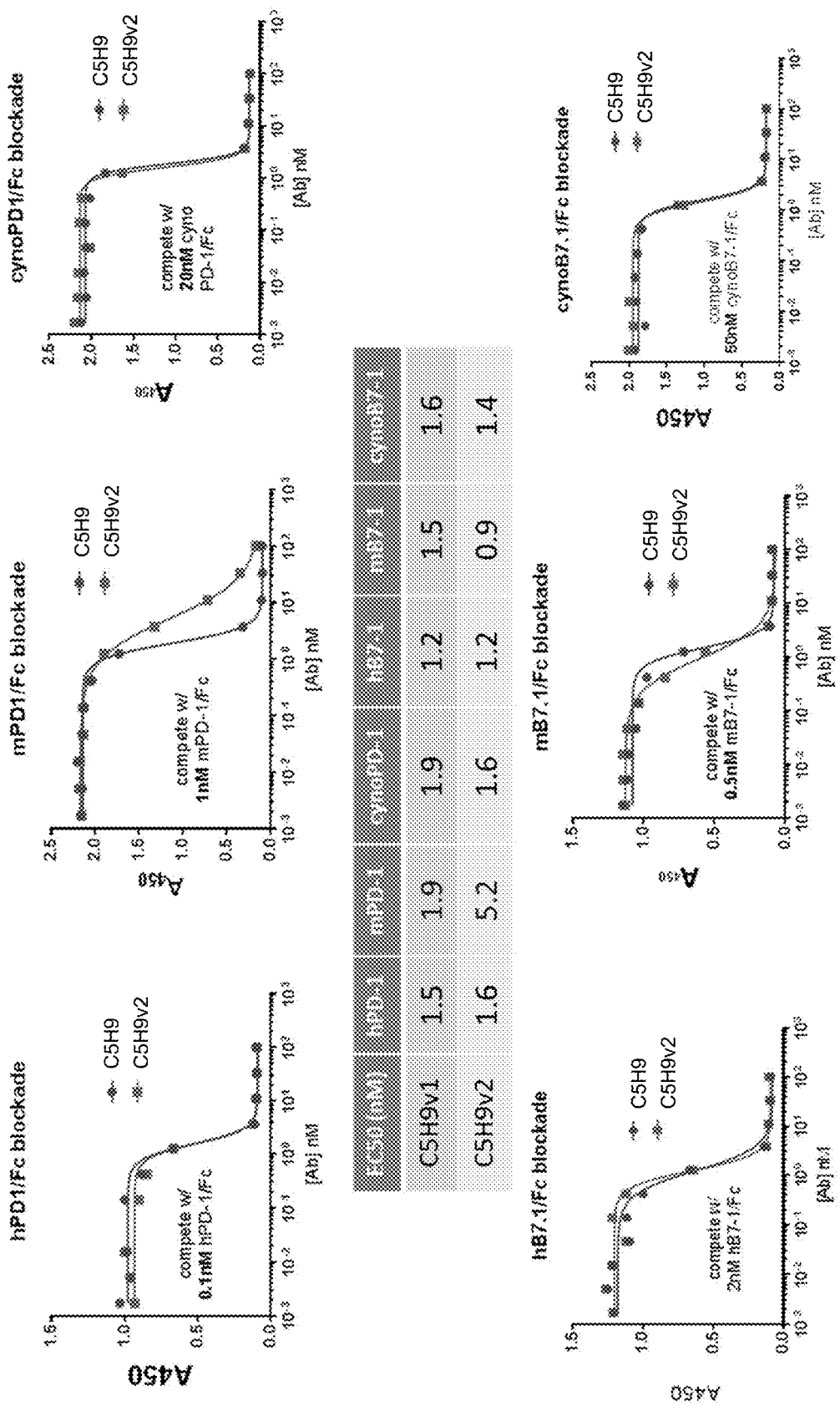
FIG. 11 is a series of graphs depicting B7-1 and PD1 blockade.

The biological activity of PDL1 is mediated through binding to PD1 and/or to B7-1. Blockade of binding is a desired characteristic for a therapeutic antibody; therefore, the potency of blocking the interaction of PDL1 with PD1 and B7-1 was measured. Briefly, human, mouse or cyno PDL1 was adsorbed to the well of an ELISA plate. Biotinylated human, mouse or cyno PD1 or B7-1 was applied to the wells in the absence or the presence of an increasing concentration of either anti-PDL1 antibody C5H9 or anti-PDL1 antibody C5H9v2 and allowed to bind. Bound biotinylated PD1 or B7-1 was visualized with a Streptavidin-HRP conjugate (Thermo Scientific, Cat. No. 21126) and developed with the chromogenic substrate TMB. FIG. 11A shows that both anti-PDL1 antibody C5H9 and anti-PDL1 antibody C5H9v2 are potent blockers of either B7-1 or PD1 binding to PDL1, and that blockade includes all three species human, cyno and mouse with single digit nM $EC_{50}$'s.

Example 7: An Anti-PDL1 Antibody of the Disclosure Accelerates Induction of Diabetes in NOD Mice In this Example, anti-PDL1 antibody C5H9 was analyzed for the ability to induce diabetes in NOD mice.

The NOD mice, substrain NOD/ShiLtJ, were obtained from Jackson Laboratory at 6 weeks and acclimated on site for 1 week. At 7 weeks, mice were checked for diabetes prior to enrollment, grouped, and dosed as set forth in Table 6.

TABLE 6

Groups and Doses for NOD study

| Group | Count | Treatment | Dose (mg/kg) Loading/regular | Dose volume (mL/kg) | Schedule | Route |
|---|---|---|---|---|---|---|
| 1 | 6 | Control | 20/10 | 10 | q2dx6 | IP |
| 2 | 6 | Anti-PDL1(C5H9) | 20/10 | 10 | q2dx6 | IP |
| 3 | 6 | Anti-PDL1 (10F9G2) | 20/10 | 10 | q2dx6 | IP |

Figure 12:
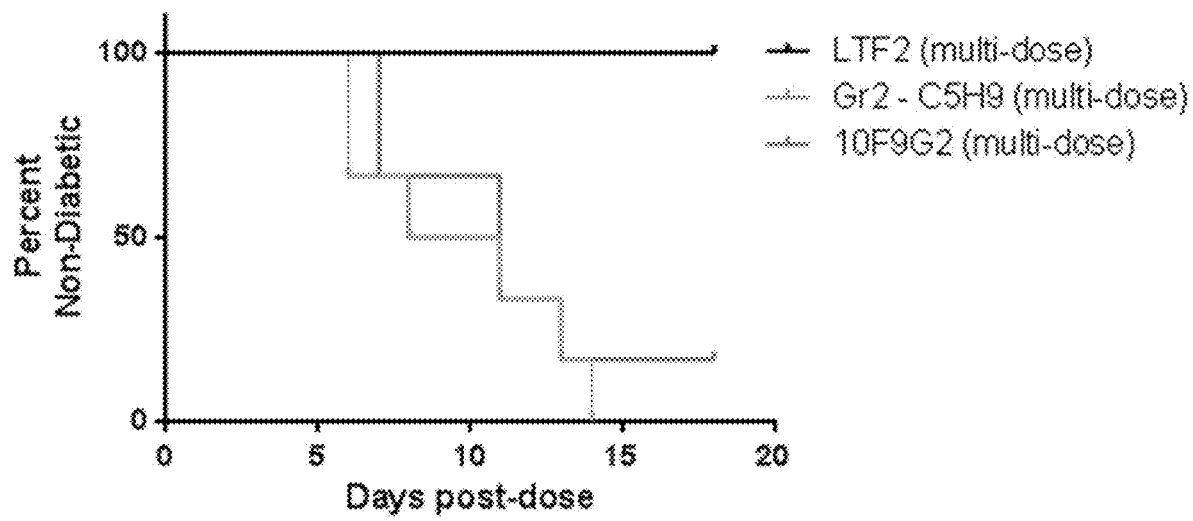
FIG. 12 is a graph depicting that anti-PDL1 antibody C5H9 accelerates the onset of diabetes in NOD mice similar to the positive control anti-PDL1 antibody 10F9G2.

FIG. 12A, which plots % non-diabetic versus number of days post initial dose, shows that anti-PDL1 antibody C5H9 antibody (Gr2-05H9) induces diabetes in NOD mice similar to positive control anti-PDL1 antibody 10F9G2 antibody. A control rat IgG2b did not induce diabetes in NOD mice.

Anti-PDL1 antibody C5H9v2 was also tested for the ability to induce diabetes in NOD mice in a dose dependent matter, using a method similar to that described above, with 9-week old animals using the groups and doses set forth in Table 7.

TABLE 7

Groups and doses for dose dependent NOD study

| Group | Count | Gender | Treatment | Dose (mg/kg) | Dose volume (mL/kg) | Schedule | Route |
|---|---|---|---|---|---|---|---|
| 1 | 8 | F | mIgG2a (C1.18.4) | 25 | 10 | Single dose | IP |
| 2 | 8 | F | Anti-PDL1 (C5H9v2) | 25 | 10 | Single dose | IP |
| 3 | 8 | F | Anti-PDL1 (C5H9v2) | 5 | 10 | Single dose | IP |
| 4 | 8 | F | Anti-PDL1 (C5H9v2) | 1 | 10 | Single dose | IP |
| 5 | 8 | F | Anti-PDL1 (C5H9v2) | 0.2 | 10 | Single dose | IP |

Figure 13:
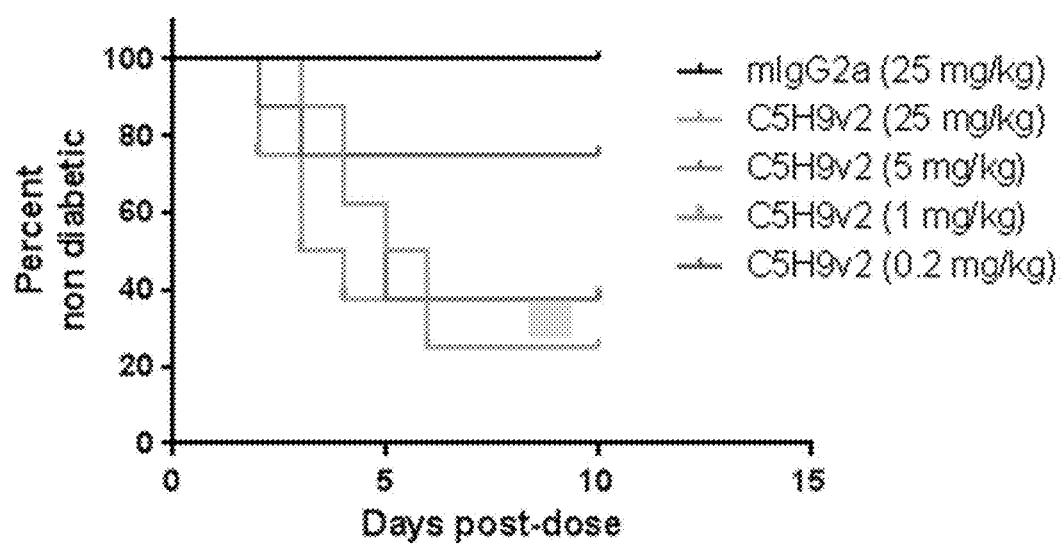
FIG. 13 is a graph depicting that anti-PDL1 antibody C5H9v2 accelerates the onset of diabetes in NOD mice in a dose dependent matter.

FIG. 13A, which plots % non-diabetic versus number of days post initial dose, demonstrates that anti-PDL1 antibody C5H9v2 induces diabetes in NOD mice in a dose dependent matter.

Example 8. An Anti-PDL1 Antibody of the Embodiments Reduces MC38 Tumors in Mice

In this Example, anti-PDL1 antibody C5H9v2 was analyzed for the ability to reduce the growth of MC38 syngeneic tumors.

The mouse colon carcinoma cell line MC38 was obtained from ATCC (American Type Culture Collection, Manassas, Va.). MC38 cells were grown in RPMI-1640 supplemented with 10% fetal bovine serum at 37° C. in an atmosphere of 5% $CO_2$ in air. Cells were harvested during the logarithmic growth period, resuspended in PBS, and kept on ice for tumor induction.

Each mouse was inoculated subcutaneously at the right flank with $1 \times 10^6$ of MC38 cells in PBS for tumor development. The treatments were started when the mean tumor size reached approximately 100-200 mm³ (no more than 200 mm³). Tumor sizes were measured twice weekly in two dimensions using a caliper, and the volume was expressed in mm³ using the formula: $V=0.5 \ a \times b^2$ where a and b are the long and short diameters of the tumor, respectively.

The mice were grouped and dosed as set forth in Table 8.

TABLE 8

Groups and doses for MC38 syngeneic study

| Group | Count | Treatment | Dose (mg/kg) | Dose volume (mL/kg) | Schedule | Route |
|---|---|---|---|---|---|---|
| 1 | 10 | Anti-PDL1 (10F9G2) | 10 | 10 | t.i.w. for 2 weeks (MWF) | IP |
| 2 | 10 | Anti-PDL1 (C5H9v2) | 10 | 10 | t.i.w. for 2 weeks (MWF) | IP |

TABLE 8-continued

Groups and doses for MC38 syngeneic study

| Group | Count | Treatment | Dose (mg/kg) | Dose volume (mL/kg) | Schedule | Route |
|---|---|---|---|---|---|---|
| 3 | 10 | mIgG2a + Hamster IgG1 | 10 | 10 | t.i.w. for 2 weeks (MWF) | IP |

Figure 14:
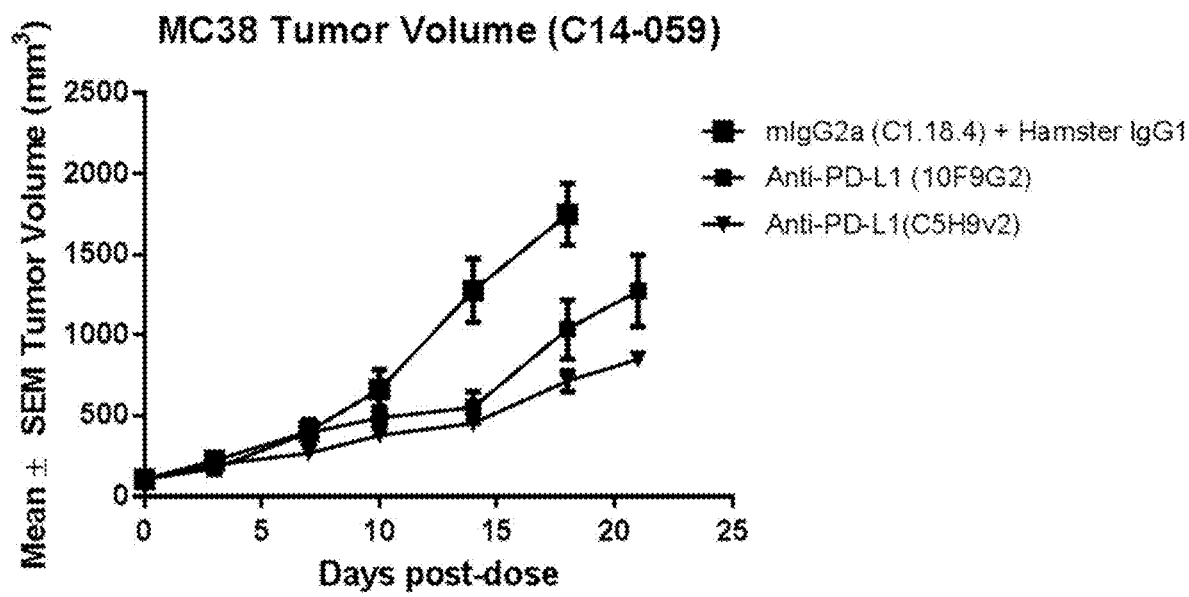
FIG. 14 is a graph depicting that an anti-PDL1 antibody C5H9v2 inhibits the growth of MC38 syngeneic tumors similar to positive control anti-PDL1 antibody 10F9G2.
Figure 15A:
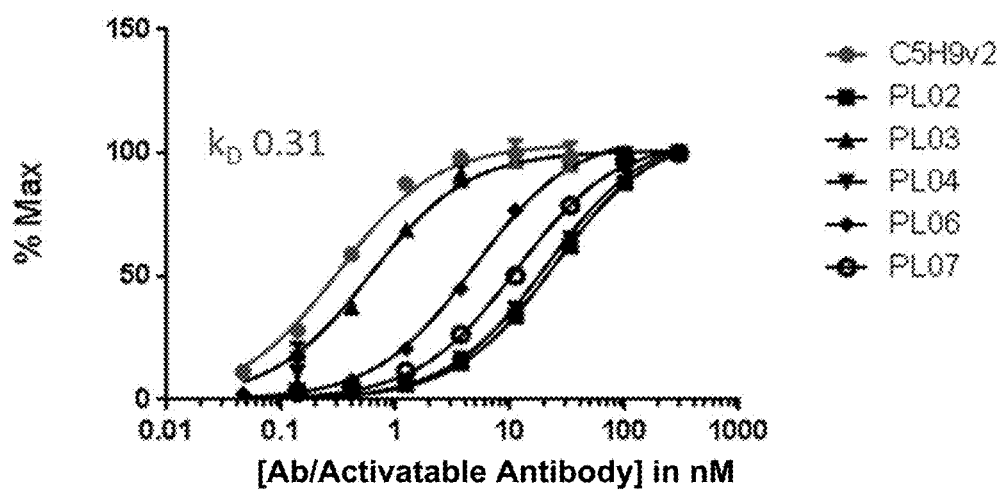
FIGS. 15A and B are a series of graphs depicting binding isotherms for anti-PDL1 activatable antibodies that include the anti-PDL1 antibody C5H9v2.
Figure 15B:
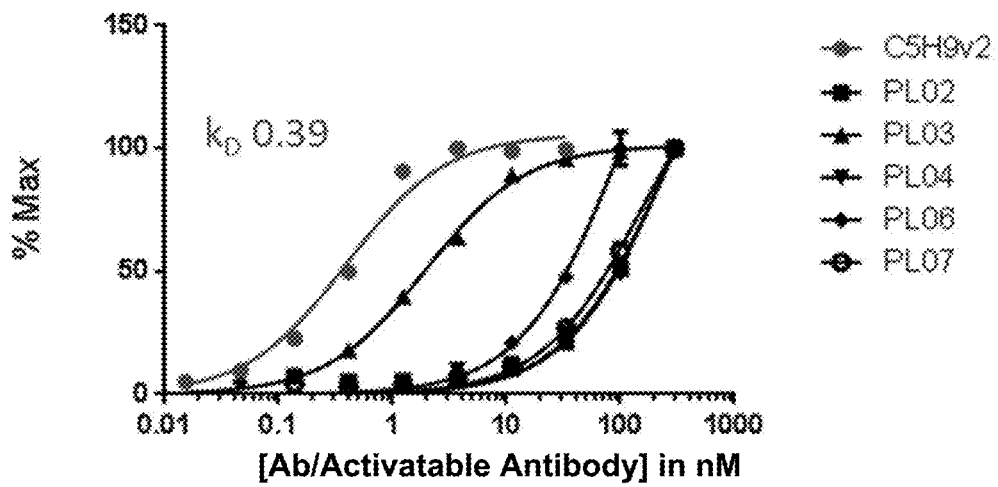
Figure 16:
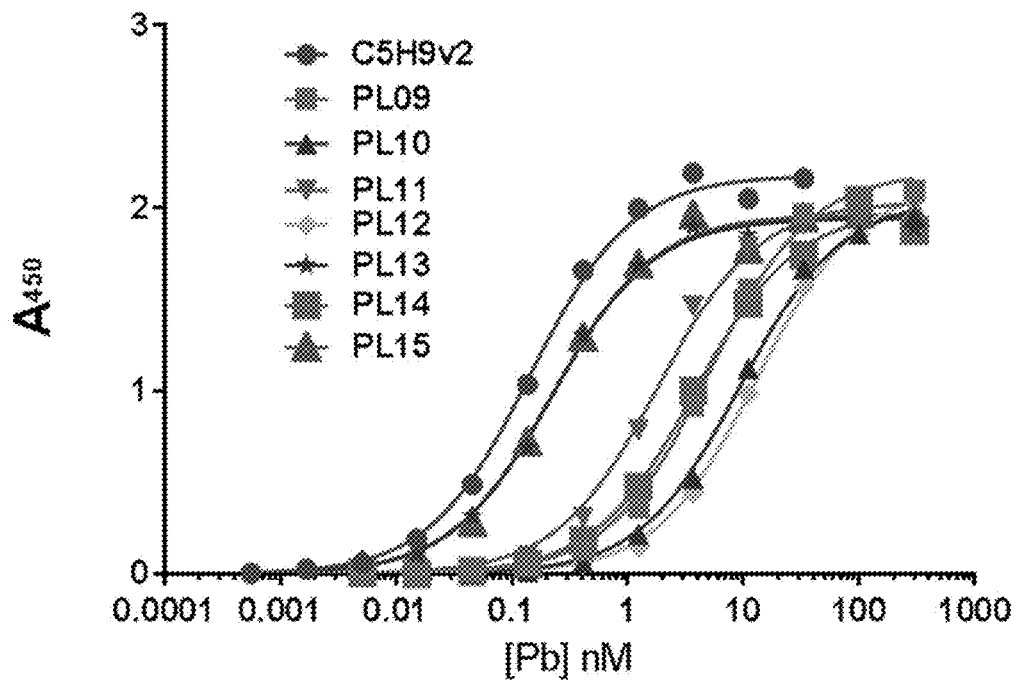
FIG. 16 is a graph depicting binding isotherms for anti-PDL1 activatable antibodies that include the anti-PDL1 antibody C5H9v2.

FIG. 14A, which plots tumor volume versus number of days post initial dose, demonstrates that anti-PDL1 antibody C5H9v2 inhibits the growth of MC38 syngeneic tumors similar to positive control anti-PDL1 antibody 10F9G2.

Example 9. Anti-PDL1 Activatable Antibody C5H9v2 Masking Moieties

This Example describes identification of masking moieties (MM) to reduce binding of activatable antibodies of anti-PDL1 antibody C5H9v2 to their target.

Anti-PDL1 antibody C5H9v2 and Fab were used to screen the libraries using a method similar to that described in PCT International Publication Number WO 2010/081173, published 15 Jul. 2010. The screening consisted of one round of MACS and three rounds of FACS sorting. The initial MACS was done with protein-A Dynabeads (Invitrogen) and the anti-PDL1 antibody C5H9v2 at a concentration of 100 nM. For MACS, approximately $1\times10^{11}$ cells were screened for binding and $6\times10^6$ cells were collected. Anti-PDL1 antibody C5H9v2, directly labeled with Alexafluor-488, was used as a probe for all FACS selections. In the first round of FACS, the cells were labeled with 100 nM AlexaFluor-anti-PDL1 antibody C5H9v2. In the second round of FACS, the cells were labeled with 10 nM AlexaFluor-anti-PDL1 antibody C5H9v2. In the third round of FACS, the cells were labeled with 1 nM AlexaFluor-anti-PDL1 antibody C5H9v2. The positive population from the third FACS round was verified to be inhibited by recombinant human PDL1 protein from binding to the anti-PDL1 antibody C5H9v2 and Fab. Individual peptide clones were identified by sequence analysis and subsequently verified for their ability to bind the anti-PDL1 antibody C5H9v2 and Fab.

The sequences of the anti-PDL1 antibody C5H9v2 masking moieties are listed in Table 9.

TABLE 9

| anti-PDL1 antibody C5H9v2 masking moieties (MM) | | |
|---|---|---|
| MM | Amino Acid Sequence | SEQ ID NO |
| PL01 | YCEVSELFVLPWCMG | SEQ ID NO: 208 |
| PL02 | SCLMHPHYAHDYCYV | SEQ ID NO: 426 |
| PL03 | LCEVLMLLQHPWCMG | SEQ ID NO: 59 |
| PL04 | IACRHFMEQLPFCHH | SEQ ID NO: 60 |
| PL05 | FGPRCGEASTCVPYE | SEQ ID NO: 61 |
| PL06 | LYCDSWGAGCLTRP | SEQ ID NO: 62 |
| PL07 | GIALCPSHFCQLPQT | SEQ ID NO: 63 |
| PL08 | DGPRCFVSGECSPIG | SEQ ID NO: 64 |
| PL09 | LCYKLDYDDRSYCHI | SEQ ID NO: 65 |
| PL10 | PCHPHPYDARPYCNV | SEQ ID NO: 66 |
| PL11 | PCYWHPFFAYRYCNT | SEQ ID NO: 67 |
| PL12 | VCYYMDWLGRNWCSS | SEQ ID NO: 68 |
| PL13 | LCDLFKLREFPYCMG | SEQ ID NO: 69 |
| PL14 | YLPCHFVPIGACNNK | SEQ ID NO: 70 |
| PL15 | FCHMGVVVPQCANY | SEQ ID NO: 71 |
| PL16 | ACHPHPYDARPYCNV | SEQ ID NO: 72 |
| PL17 | PCHPAPYDARPYCNV | SEQ ID NO: 73 |
| PL18 | PCHPHAYDARPYCNV | SEQ ID NO: 74 |
| PL19 | PCHPHPADARPYCNV | SEQ ID NO: 75 |
| PL20 | PCHPHPYAARPYCNV | SEQ ID NO: 76 |
| PL21 | PCHPHPYDAAPYCNV | SEQ ID NO: 77 |
| PL22 | PCHPHPYDARPACNV | SEQ ID NO: 78 |
| PL23 | PCHPHPYDARPYCAV | SEQ ID NO: 79 |
| PL24 | PCHAHPYDARPYCNV | SEQ ID NO: 80 |
| PL25 | PCHPHPYDARAYCNV | SEQ ID NO: 81 |

Example 10. Activatable Antibodies Comprising Anti-PDL1 Antibody C5H9v2

This Example describes examples of activatable antibodies of the disclosure comprising anti-PDL1 antibody C5H9v2.

Anti-PDL1 activatable antibodies comprising an anti-PDL1 antibody C5H9v2 masking moiety, a cleavable moiety, and anti-PDL1 antibody C5H9v2 were produced according to methods similar to those described in PCT Publication Nos. WO 2009/025846 and WO 2010/081173. Quality control of the resultant activatable antibodies indicated that most comprised at least 95% monomer. The amino acid and nucleic acid sequences of several activatable antibodies comprising anti-PDL1 antibody C5H9v2 are provided below. Each activatable antibody comprises anti-PDL1 antibody C5H9v2 having the variable heavy chain amino acid sequence shown in SEQ ID NO: 46 and a light chain amino acid sequence selected from the group consisting of the amino acid sequences shown in SEQ ID NO: 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1144-1191, 1200, and 1201 below.

While the sequences shown below include the spacer sequence of SEQ ID NO: 923, those of ordinary skill in the art appreciate that the activatable anti-PDL1 antibodies of the disclosure can include any suitable spacer sequence, such as, for example, a spacer sequence selected from the group consisting of QGQSGS (SEQ ID NO: 923); GQSGS (SEQ ID NO: 1192); QSGS (SEQ ID NO: 1193); SGS (SEQ ID NO: 1194); GS (SEQ ID NO: 1195); S; QGQSGQG (SEQ ID NO: 924); GQSGQG (SEQ ID NO: 395); QSGQG (SEQ ID NO: 925); SGQG (SEQ ID NO: 926); GQG (SEQ ID NO: 927); QG (SEQ ID NO: 928); G; GQGSGQ (SEQ ID NO: 1196); GQSGQ (SEQ ID NO: 1197); QSGQ (SEQ ID NO: 1198); SGQ (SEQ ID NO: 616); GQ (SEQ ID NO: 1199); and Q. While the sequences shown below include the spacer sequence of SEQ ID NO: 923, those of ordinary skill in the art will also appreciate that activatable anti-PDL1 antibodies of the disclosure in some embodiments do not include a spacer sequence.

```
C5H9v2 VH amino acid sequence
EVQLLESGGGLVQPGGSLRLSCAASGFTFSSYAMSWVRQAPGKGLEWVSSIWRNGIVTVYADSVKGRFTI

SRDNSKNTLYLQMNSLRAEDTAVYYCAKWSAAFDYWGQGTLVIVSS (SEQ ID NO: 46)

[spacer (SEQ ID NO: 929)][PL01-0003 LC (SEQ ID NO: 930)]
[CAAGGTCAGTCTGGATCC][TATTGCGAGGTTAGTGAGCTGTTTGTTCTTCCTTGGTGCATGGGTGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 82)

[spacer (SEQ ID NO: 923)][PL01-0003 LC (SEQ ID NO: 931)]
[QGQSGS][YCEVSELFVLPWCMGGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 83)

PL01-0003 LC nucleotide sequence
TATTGCGAGGTTAGTGAGCTGTTTGTTCTTCCTTGGTGCATGGGTGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 930)

PL01-0003 LC amino acid sequence
YCEVSELFVLPWCMGGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 931)

[spacer (SEQ ID NO: 929)][PL02-0003 LC (SEQ ID NO: 932)]
[CAAGGTCAGTCTGGATCC][TCTTGCCTTATGCATCCGCATTATGCTCATGATTATTGCTATGTTGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 84)
```

-continued

[spacer (SEQ ID NO: 923)][PL02-0003 LC (SEQ ID NO: 933)]
[QGQSGS][SCLMHPHYAHDYCYVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFILTISSLQPEDFATYYC

QQDNGYPSTFGGGTKVEIKR] (SEQ ID NO: 85)

PL02-0003 LC nucleotide sequence
TCTTGCCTTATGCATCCGCATTATGCTCATGATTATTGCTATGTTGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 932)

PL02-0003 LC amino acid sequence
SCLMHPHYAHDYCYVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 933)

[spacer (SEQ ID NO: 929)][PL03-0003 LC (SEQ ID NO: 934)]
[CAAGGTCAGTCTGGATCC][TTGTGCGAGGTTTTGATGTTGTTGCAGCATCCGTGGTGCATGGGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 86)

[spacer (SEQ ID NO: 923)][PL03-0003 LC (SEQ ID NO: 935)]
[QGQSGS][LCEVLMLLQHPWCMGGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 87)

PL03-0003 LC nucleotide sequence
TTGTGCGAGGTTTTGATGTTGTTGCAGCATCCGTGGTGCATGGGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 934)

PL03-0003 LC amino acid sequence
LCEVLMLLQHPWCMGGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 935)

[spacer (SEQ ID NO: 929)][PL04-0003 LC (SEQ ID NO: 936)]
[CAAGGTCAGTCTGGATCC][ATTGCGTGCCGGCATTTTATGGAGCAGTTGCCGTTTTGCCATCATGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 88)

[spacer (SEQ ID NO: 923)][PL04-0003 LC (SEQ ID NO: 937)]
[QGQSGS][IACRHFMEQLPFCHHGGGSSGGSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 89)

PL04-0003 LC nucleotide sequence
ATTGCGTGCCGGCATTTTATGGAGCAGTTGCCGTTTTGCCATCATGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 936)

PL04-0003 LC amino acid sequence
IACRHEMEQLPFCHHGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 937)

[spacer (SEQ ID NO: 929)][PL05-0003 LC (SEQ ID NO: 938)]
[CAAGGTCAGTCTGGATCC][TTTGGTCCTAGGTGCGGTGAGGCTTCTACTTGCGTTCCGTATGAGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 90)

[spacer (SEQ ID NO: 923)][PL05-0003 LC (SEQ ID NO: 939)]
[QGQSGS][FGPRCGEASTCVPYEGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 91)

PL05-0003 LC nucleotide sequence
TTTGGTCCTAGGTGCGGTGAGGCTTCTACTTGCGTTCCGTATGAGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

-continued

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 938)

PL05-0003 LC amino acid sequence
FGPRCGEASTCVPYEGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 939)

[spacer (SEQ ID NO: 929)][PL06-0003 LC (SEQ ID NO: 940)]
[CAAGGTCAGTCTGGATCC][ATTCTTTATTGCGATAGTTGGGGGCGGGGTGCTTGACGCGGCCGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 92)

[spacer (SEQ ID NO: 923)][PL06-0003 LC (SEQ ID NO: 941)]
[QGQSGS][ILYCDSWGAGCLTRPGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 93)

PL06-0003 LC nucleotide sequence
ATTCTTTATTGCGATAGTTGGGGGCGGGGTGCTTGACGCGGCCGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 940)

PL06-0003 LC amino acid sequence
ILYCDSWGAGCLIRPGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 941)

[spacer (SEQ ID NO: 929)] [PL07-0003 LC (SEQ ID NO: 942)]
[CAAGGTCAGTCTGGATCC][GGGATTGCGTTGTGCCCGTCTCATTTTTGCCAGCTGCCTCAGACTGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 94)

-continued

[spacer (SEQ ID NO: 923)] [PL07-0003 LC (SEQ ID NO: 943)]
[QGQSGS][GIALCPSHFCQLPQTGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 95)

PL07-0003 LC nucleotide sequence
GGGATTGCGTTGTGCCCGTCTCATTTTTGCCAGCTGCCTCAGACTGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 942)

PL07-0003 LC amino acid sequence
GIALCPSHFCQLPQTGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 943)

[spacer (SEQ ID NO: 929)] [PL08-0003 LC (SEQ ID NO: 944)]
[CAAGGTCAGTCTGGATCC][GATGGGCCGCGTTGCTTTGTGTCGGGGAGTGCTCTCCGATTGGTGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 96)

[spacer (SEQ ID NO: 923)] [PL08-0003 LC (SEQ ID NO: 945)]
[QGQSGS][DGPRCFVSGECSPIGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 97)

PL08-0003 LC nucleotide sequence
GATGGGCCGCGTTGCTTTGTGTCGGGGAGTGCTCTCCGATTGGTGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 944)

PL08-0003 LC amino acid sequence
DGPRCEVSGECSPIGGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 945)

-continued

[spacer (SEQ ID NO: 929)][PL09-0003 LC (SEQ ID NO: 946)]
[CAAGGTCAGTCTGGATCC][TTGTGCTATAAGCTGGATTATGATGATAGGTCTTATTGCCATATTGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 98)

[spacer (SEQ ID NO: 923)][PL09-0003 LC (SEQ ID NO: 947)]
[QGQSGS][LCYKLDYDDRSYCHIGGGSSGGSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFILTISSLQPEDFATYYC

QQDNGYPSTFGGGTKVEIKR] (SEQ ID NO: 99)

PL09-0003 LC nucleotide sequence
TTGTGCTATAAGCTGGATTATGATGATAGGTCTTATTGCCATATTGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 946)

PL09-0003 LC amino acid sequence
LCYKLDYDDRSYCHIGGGSSGGSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 947)

[spacer (SEQ ID NO: 929)][PL10-0003 LC (SEQ ID NO: 948)]
[CAAGGTCAGTCTGGATCC][CCGTGCCATCCGCATCCTTATGATGCTCGTCCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 100)

[spacer (SEQ ID NO: 923)] [PL10-0003 LC (SEQ ID NO: 949)]
[QGQSGS][PCHPHPYDARPYCNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR](SEQ ID NO: 101)

PL10-0003 LC nucleotide sequence
CCGTGCCATCCGCATCCTTATGATGCTCGTCCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 948)

PL10-0003 LC amino acid sequence
PCHPHPYDARPYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 949)

[spacer (SEQ ID NO: 929)] [PL11-0003 LC (SEQ ID NO: 950)]
[CAAGGTCAGTCTGGATCC][CCTTGCTATTGGCATCCTTTTTTTGCGTATAGGTATTGCAATACTGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 102)

[spacer (SEQ ID NO: 923)][PL11-0003 LC (SEQ ID NO: 951)]
[QGQSGS][PCYWHPFFAYRYCNTGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 103)

PL11-0003 LC nucleotide sequence
CCTTGCTATTGGCATCCTTTTTTTGCGTATAGGTATTGCAATACTGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 950)

PL11-0003 LC amino acid sequence
PCYWHPFFAYRYCNIGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 951)

[spacer (SEQ ID NO: 929)][PL12-0003 LC (SEQ ID NO: 952)]
[CAAGGTCAGTCTGGATCC][GTTTGCTATTATATGGATTGGTTGGGGCGGAATTGGTGCTCTTCGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 104)

[spacer (SEQ ID NO: 923)][PL12-0003 LC (SEQ ID NO: 953)]
[QGQSGS][VCYYMDWLGRNWCSSGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 105)

PL12-0003 LC nucleotide sequence
GTTTGCTATTATATGGATTGGTTGGGGCGGAATTGTGCTCTTCGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 952)

PL12-0003 LC amino acid sequence
VCYYMDWLGRNWCSSGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 953)

[spacer (SEQ ID NO: 929)] [PL13-0003 LC (SEQ ID NO: 954)]
[CAAGGTCAGTCTGGATCC][CTGTGCGATCTGTTTAAGTTGCGTGAGTTTCCTTATTGCATGGGGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 106)

[spacer (SEQ ID NO: 923)] [PL13-0003 LC (SEQ ID NO: 955)]
[QGQSGS][LCDLFKLREFPYCMGGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 107)

PL13-0003 LC nucleotide sequence
CTGTGCGATCTGTTTAAGTTGCGTGAGTTTCCTTATTGCATGGGGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 954)

PL13-0003 LC amino acid sequence
LCDLFKLREFPYCMGGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 955)

[spacer (SEQ ID NO: 929)][PL14-0003 LC (SEQ ID NO: 956)]
[CAAGGTCAGTCTGGATCC][TATCTTCCGTGCCATTTTGTTCCGATTGGGGCTTGCAATAATAAGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 108)

[spacer (SEQ ID NO: 923)][PL14-0003 LC (SEQ ID NO: 957)]
[QGQSGS][YLPCHFVPIGACNNKGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 109)

PL14-0003 LC nucleotide sequence
TATCTTCCGTGCCATTTTGTTCCGATTGGGGCTTGCAATAATAAGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 956)

PL14-0003 LC amino acid sequence
YLPCHFVPIGACNNKGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 957)

[spacer (SEQ ID NO: 929)][PL15-0003 LC (SEQ ID NO: 958)]
[CAAGGTCAGTCTGGATCC][ATTTTTTGCCATATGGGTGTTGTGGTTCCTCAGTGCGCGAATTATGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 110)

[spacer (SEQ ID NO: 923)][PL15-0003 LC (SEQ ID NO: 959)]
[QGQSGS][IFCHMGVVVPQCANYGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 111)

PL15-0003 LC nucleotide sequence
ATTTTTTGCCATATGGGTGTTGTGGTTCCTCAGTGCGCGAATTATGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

```
CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 958)
```

PL15-0003 LC amino acid sequence
IFCHMGVVVPQCANYGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 959)

[spacer (SEQ ID NO: 929)][PL16-0003 LC (SEQ ID NO: 960)]
[CAAGGTCAGTCTGGATCC][GCGTGCCATCCGCATCCTTATGATGCTCGTCCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 112)

[spacer (SEQ ID NO: 923)][PL16-0003 LC (SEQ ID NO: 961)]
[QGQSGS][ACHPHPYDARPYCNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 113)

PL16-0003 LC nucleotide sequence
GCGTGCCATCCGCATCCTTATGATGCTCGTCCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 960)

PL16-0003 LC amino acid sequence
ACHPHPYDARPYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 961)

[spacer (SEQ ID NO: 929)][PL17-0003 LC (SEQ ID NO: 962)]
[CAAGGTCAGTCTGGATCC][CCGTGCCATCCGGCTCCTTATGATGCTCGTCCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 114)

-continued

[spacer (SEQ ID NO: 923)] [PL17-0003 LC (SEQ ID NO: 963)]
[QGQSGS][PCHPAPYDARPYCNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 115)

PL17-0003 LC nucleotide sequence
CCGTGCCATCCGGCTCCTTATGATGCTCGTCCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 962)

PL17-0003 LC amino acid sequence
PCHPAPYDARPYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 963)

[spacer (SEQ ID NO: 929)][PL18-0003 LC (SEQ ID NO: 964)]
[CAAGGTCAGTCTGGATCC][CCGTGCCATCCGCATGCTTATGATGCTCGTCCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 116)

[spacer (SEQ ID NO: 923)][PL18-0003 LC (SEQ ID NO: 965)]
[QGQSGS][PCHPHAYDARPYCNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 117)

PL18-0003 LC nucleotide sequence
CCGTGCCATCCGCATGCTTATGATGCTCGTCCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 964)

PL18-0003 LC amino acid sequence
PCHPHAYDARPYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 965)

[spacer (SEQ ID NO: 929)][PL19-0003 LC (SEQ ID NO: 966)]
[CAAGGTCAGTCTGGATCC][CCGTGCCATCCGCATCCTGCTGATGCTCGTCCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 118)

[spacer (SEQ ID NO: 923)][PL19-0003 LC (SEQ ID NO: 967)]
[QGQSGS][PCHPHPADARPYCNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 119)

PL19-0003 LC nucleotide sequence
CCGTGCCATCCGCATCCTGCTGATGCTCGTCCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 966)

PL19-0003 LC amino acid sequence
PCHPHPADARPYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 967)

[spacer (SEQ ID NO: 929)][PL20-0003 LC (SEQ ID NO: 968)]
[CAAGGTCAGTCTGGATCC][CCGTGCCATCCGCATCCTTATGCTGCTCGTCCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 120)

[spacer (SEQ ID NO: 923)][PL20-0003 LC (SEQ ID NO: 969)]
[QGQSGS][PCHPHPYAARPYCNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 121)

PL20-0003 LC nucleotide sequence
CCGTGCCATCCGCATCCTTATGCTGCTCGTCCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 968)

PL20-0003 LC amino acid sequence
PCHPHPYAARPYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 969)

[spacer (SEQ ID NO: 929)][PL21-0003 LC (SEQ ID NO: 970)]
[CAAGGTCAGTCTGGATCC][CCGTGCCATCCGCATCCTTATGATGCTGCTCCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 122)

[spacer (SEQ ID NO: 923)][PL21-0003 LC (SEQ ID NO: 971)]
[QGQSGS][PCHPHPYDAAPYCNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 123)

PL21-0003 LC nucleotide sequence
CCGTGCCATCCGCATCCTTATGATGCTGCTCCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 970)

PL21-0003 LC amino acid sequence
PCHPHPYDAAPYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 971)

[spacer (SEQ ID NO: 929)] [PL22-0003 LC (SEQ ID NO: 972)]
[CAAGGTCAGTCTGGATCC][CCGTGCCATCCGCATCCTTATGATGCTCGTCCTGCTTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 124)

-continued

[spacer (SEQ ID NO: 923)] [PL22-0003 LC (SEQ ID NO: 973)]
[QGQSGS][PCHPHPYDARPACNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 125)

PL22-0003 LC nucleotide sequence
CCGTGCCATCCGCATCCTTATGATGCTCGTCCTGCTTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 972)

PL22-0003 LC amino acid sequence
PCHPHPYDARPACNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 973)

[spacer (SEQ ID NO: 929)][PL23-0003 LC (SEQ ID NO: 974)]
[CAAGGTCAGTCTGGATCC][CCGTGCCATCCGCATCCTTATGATGCTCGTCCTTATTGCGCTGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 126)

[spacer (SEQ ID NO: 923)][PL23-0003 LC (SEQ ID NO: 975)]
[QGQSGS][PCHPHPYDARPYCAVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFILTISSLQPEDFATYYC

QQDNGYPSTFGGGTKVEIKR] (SEQ ID NO: 127)

PL23-0003 LC nucleotide sequence
CCGTGCCATCCGCATCCTTATGATGCTCGTCCTTATTGCGCTGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 974)

PL23-0003 LC amino acid sequence
PCHPHPYDARPYCAVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 975)

[spacer (SEQ ID NO: 929)][PL24-0003 LC (SEQ ID NO: 976)]
[CAAGGTCAGTCTGGATCC][CCGTGCCATGCGCATCCTTATGATGCTCGTCCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 128)

[spacer (SEQ ID NO: 923)][PL24-0003 LC (SEQ ID NO: 977)]
[QGQSGS][PCHAHPYDARPYCNVGGGSSGGSGGSGGTSTSGRSANPRGGGSDIQMTQSPSSLSASVGDR

VTITCRASQSISSYLNWYQQKPGKAPKLLIYAASSLQSGVPSRFSGSGSGTDFTLTISSLQPEDFATYYC

QQDNGYPSTFGGGTKVEIKR] (SEQ ID NO: 129)

PL24-0003 LC nucleotide sequence
CCGTGCCATGCGCATCCTTATGATGCTCGTCCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 976)

PL24-0003 LC amino acid sequence
PCHAHPYDARPYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 977)

[spacer (SEQ ID NO: 929)] [PL25-0003 LC (SEQ ID NO: 978)]
[CAAGGTCAGTCTGGATCC][CCGTGCCATCCGCATCCTTATGATGCTCGTGCTTATTGCAATGTGGGAG

GTGGCTCGAGCGGTGGCAGCGGTGGCTCTGGTGGTACTAGCACCTCTGGTCGTTCCGCTAACCCACGTGG

CGGCGGTTCTGACATCCAGATGACCCAGAGCCCCAGCAGCCTGTCTGCTAGCGTGGGCGACAGAGTGACC

ATCACCTGTAGAGCCAGCCAGAGCATCAGCAGCTACCTGAACTGGTATCAGCAGAAGCCCGGCAAGGCCC

CCAAACTGCTGATCTACGCCGCCAGCTCTCTGCAGTCTGGCGTGCCCAGCAGATTTTCCGGCAGCGGCTC

TGGCACCGACTTCACCCTGACCATCAGCTCCCTGCAGCCCGAGGACTTCGCCACCTACTACTGCCAGCAG

GACAACGGCTACCCCAGCACCTTTGGCGGAGGTACCAAGGTGGAAATCAAGCGTTGTGAGGCCACTCACA

AGACATCAACTTCACCCATTGTCAAGAGCTTCAACAGGAATGAGTGT] (SEQ ID NO: 130)

[spacer (SEQ ID NO: 923)][PL25-0003 LC (SEQ ID NO: 979)]
[QGQSGS][PCHPHPYDARAYCNVGGGSSGGSGGSGGTSTSGRSANPRGGGSDIQMTQSPSSLSASVGDR
VTITCRASQSISSYLNWYQQKPGKAPKLLIYAASSLQSGVPSRFSGSGSGTDFTLTISSLQPEDFATYYC
QQDNGYPSTFGGGTKVEIKR] (SEQ ID NO: 131)
PL25-0003 LC nucleotide sequence
CCGTGCCATCCGCATCCTTATGATGCTCGTGCTTATTGCAATGTGGGAGGTGGCTCGAGCGGTGGCAGCG

GTGGCTCTGGTGGTACTAGCACCTCTGGTCGTTCCGCTAACCCACGTGGCGGCGGTTCTGACATCCAGAT

GACCCAGAGCCCCAGCAGCCTGTCTGCTAGCGTGGGCGACAGAGTGACCATCACCTGTAGAGCCAGCCAG

AGCATCAGCAGCTACCTGAACTGGTATCAGCAGAAGCCCGGCAAGGCCCCCAAACTGCTGATCTACGCCG

CCAGCTCTCTGCAGTCTGGCGTGCCCAGCAGATTTTCCGGCAGCGGCTCTGGCACCGACTTCACCCTGAC

```
CATCAGCTCCCTGCAGCCCGAGGACTTCGCCACCTACTACTGCCAGCAGGACAACGGCTACCCCAGCACC

TTTGGCGGAGGTACCAAGGTGGAAATCAAGCGTTGTGAGGCCACTCACAAGACATCAACTTCACCCATTG

TCAAGAGCTTCAACAGGAATGAGTGT (SEQ ID NO: 978)

PL25-0003 LC amino acid sequence
PCHPHPYDARAYCNVGGGSSGGSGGSGGISTSGRSANPRGGGSDIQMIQSPSSLSASVGDRVTITCRASQ

SISSYLNWYQQKPGKAPKLLIYAASSLQSGVPSRFSGSGSGTDFTLTISSLQPEDFATYYCQQDNGYPST

FGGGTKVEIKR (SEQ ID NO: 979)

[spacer (SEQ ID NO: 929)][PL03-2001 LC (SEQ ID NO: 980)]
[CAAGGTCAGTCTGGATCC][GGAGGTGGCTCGAGCGGTGGCAGCGGTGGCTCTGGTGGTATTAGCAGTG

GTCTGTTAAGCGGTCGTAGCGATAATCATGGCGGTTCTGACATCCAGATGACCCAGAGCCCCAGCAGCCT

GTCTGCTAGCGTGGGCGACAGAGTGACCATCACCTGTAGAGCCAGCCAGAGCATCAGCAGCTACCTGAAC

TGGTATCAGCAGAAGCCCGGCAAGGCCCCCAAACTGCTGATCTACGCCGCCAGCTCTCTGCAGTCTGGCG

TGCCCAGCAGATTTTCCGGCAGCGGCTCTGGCACCGACTTCACCCTGACCATCAGCTCCCTGCAGCCCGA

GGACTTCGCCACCTACTACTGCCAGCAGGACAACGGCTACCCCAGCACCTTTGGCGGAGGTACCAAGGTG

GAAATCAAGCGTTGTGAGGCCACTCACAAGACATCAACTTCACCCATTGTCAAGAGCTTCAACAGGAATG

AGTGT] (SEQ ID NO: 132)

[spacer (SEQ ID NO: 923)][PL03-2001 LC (SEQ ID NO: 981)]
[QGQSGS][LCEVLMLLQHPWCMGGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 133)

PL03-2001 LC nucleotide sequence
GGAGGTGGCTCGAGCGGTGGCAGCGGTGGCTCTGGTGGTATTAGCAGTGGTCTGTTAAGCGGTCGTAGCG

ATAATCATGGCGGTTCTGACATCCAGATGACCCAGAGCCCCAGCAGCCTGTCTGCTAGCGTGGGCGACAG

AGTGACCATCACCTGTAGAGCCAGCCAGAGCATCAGCAGCTACCTGAACTGGTATCAGCAGAAGCCCGGC

AAGGCCCCCAAACTGCTGATCTACGCCGCCAGCTCTCTGCAGTCTGGCGTGCCCAGCAGATTTTCCGGCA

GCGGCTCTGGCACCGACTTCACCCTGACCATCAGCTCCCTGCAGCCCGAGGACTTCGCCACCTACTACTG

CCAGCAGGACAACGGCTACCCCAGCACCTTTGGCGGAGGTACCAAGGTGGAAATCAAGCGTTGTGAGGCC

ACTCACAAGACATCAACTTCACCCATTGTCAAGAGCTTCAACAGGAATGAGTGT (SEQ ID NO: 980)

PL03-2001 LC amino acid sequence
LCEVLMLLQHPWCMGGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 981)

[spacer (SEQ ID NO: 923)][PL04-2001 LC (SEQ ID NO: 1183)]
[QGQSGS][IACRHFMEQLPFCHHGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1182)

PL04-2001 LC amino acid sequence
IACRHFMEQLPFCHHGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 1183)

[spacer (SEQ ID NO: 929)][PL06-2001-mk LC (SEQ ID NO: 982)]
[CAAGGTCAGTCTGGATCC][GGAGGTGGCTCGAGCGGTGGCAGCGGTGGCTCTGGTGGTATTAGCAGTG

GTCTGTTAAGCGGTCGTAGCGATAATCATGGCGGTTCTGACATCCAGATGACCCAGAGCCCCAGCAGCCT

GTCTGCTAGCGTGGGCGACAGAGTGACCATCACCTGTAGAGCCAGCCAGAGCATCAGCAGCTACCTGAAC

TGGTATCAGCAGAAGCCCGGCAAGGCCCCCAAACTGCTGATCTACGCCGCCAGCTCTCTGCAGTCTGGCG
```

TGCCCAGCAGATTTTCCGGCAGCGGCTCTGGCACCGACTTCACCCTGACCATCAGCTCCCTGCAGCCCGA

GGACTTCGCCACCTACTACTGCCAGCAGGACAACGGCTACCCCAGCACCTTTGGCGGAGGTACCAAGGTG

GAAATCAAGCGTTGTGAGGCCACTCACAAGACATCAACTTCACCCATTGTCAAGAGCTTCAACAGGAATG

AGTGT] (SEQ ID NO: 134)

[spacer (SEQ ID NO: 923)] [PL06-2001-mk LC (SEQ ID NO: 983)]
[QGQSGS][ILYCDSWGAGCLTRPGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFILTISSLQPEDFATYY

CQQDNGYPSTFGGGTKVEIKR](SEQ ID NO: 135)

PL06-2001-mk LC nucleotide sequence
GGAGGTGGCTCGAGCGGTGGCAGCGGTGGCTCTGGTGGTATTAGCAGTGGTCTGTTAAGCGGTCGTAGCG

ATAATCATGGCGGTTCTGACATCCAGATGACCCAGAGCCCCAGCAGCCTGTCTGCTAGCGTGGGCGACAG

AGTGACCATCACCTGTAGAGCCAGCCAGAGCATCAGCAGCTACCTGAACTGGTATCAGCAGAAGCCCGGC

AAGGCCCCCAAACTGCTGATCTACGCCGCCAGCTCTCTGCAGTCTGGCGTGCCCAGCAGATTTTCCGGCA

GCGGCTCTGGCACCGACTTCACCCTGACCATCAGCTCCCTGCAGCCCGAGGACTTCGCCACCTACTACTG

CCAGCAGGACAACGGCTACCCCAGCACCTTTGGCGGAGGTACCAAGGTGGAAATCAAGCGTTGTGAGGCC

ACTCACAAGACATCAACTTCACCCATTGTCAAGAGCTTCAACAGGAATGAGTGT (SEQ ID NO: 982)

PL06-2001-mk LC amino acid sequence
ILYCDSWGAGCLTRPGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 983)

[spacer (SEQ ID NO: 929)][PL07-2001 LC (SEQ ID NO: 984)]
[CAAGGTCAGTCTGGATCC][GGAGGTGGCTCGAGCGGTGGCAGCGGTGGCTCTGGTGGTATTAGCAGTG

GTCTGTTAAGCGGTCGTAGCGATAATCATGGCGGTTCTGACATCCAGATGACCCAGAGCCCCAGCAGCCT

GTCTGCTAGCGTGGGCGACAGAGTGACCATCACCTGTAGAGCCAGCCAGAGCATCAGCAGCTACCTGAAC

TGGTATCAGCAGAAGCCCGGCAAGGCCCCCAAACTGCTGATCTACGCCGCCAGCTCTCTGCAGTCTGGCG

TGCCCAGCAGATTTTCCGGCAGCGGCTCTGGCACCGACTTCACCCTGACCATCAGCTCCCTGCAGCCCGA

GGACTTCGCCACCTACTACTGCCAGCAGGACAACGGCTACCCCAGCACCTTTGGCGGAGGTACCAAGGTG

GAAATCAAGCGTTGTGAGGCCACTCACAAGACATCAACTTCACCCATTGTCAAGAGCTTCAACAGGAATG

AGTGT] (SEQ ID NO: 136)

[spacer (SEQ ID NO: 923)][PL07-2001 LC (SEQ ID NO: 985)]
[QGQSGS][GIALCPSHFCQLPQTGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 137)

PL07-2001 LC nucleotide sequence
GGAGGTGGCTCGAGCGGTGGCAGCGGTGGCTCTGGTGGTATTAGCAGTGGTCTGTTAAGCGGTCGTAGCG

ATAATCATGGCGGTTCTGACATCCAGATGACCCAGAGCCCCAGCAGCCTGTCTGCTAGCGTGGGCGACAG

AGTGACCATCACCTGTAGAGCCAGCCAGAGCATCAGCAGCTACCTGAACTGGTATCAGCAGAAGCCCGGC

AAGGCCCCCAAACTGCTGATCTACGCCGCCAGCTCTCTGCAGTCTGGCGTGCCCAGCAGATTTTCCGGCA

GCGGCTCTGGCACCGACTTCACCCTGACCATCAGCTCCCTGCAGCCCGAGGACTTCGCCACCTACTACTG

CCAGCAGGACAACGGCTACCCCAGCACCTTTGGCGGAGGTACCAAGGTGGAAATCAAGCGTTGTGAGGCC

ACTCACAAGACATCAACTTCACCCATTGTCAAGAGCTTCAACAGGAATGAGTGT (SEQ ID NO: 984)

PL07-2001 LC amino acid sequence
GIALCPSHFCQLPQTGGGSSGGSGGSGGIISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 985)

[spacer (SEQ ID NO: 929)][PL10-2001 LC (SEQ ID NO: 986)]
[CAAGGTCAGTCTGGATCC][GGAGGTGGCTCGAGCGGTGGCAGCGGTGGCTCTGGTGGTATTAGCAGTG

GTCTGTTAAGCGGTCGTAGCGATAATCATGGCGGTTCTGACATCCAGATGACCCAGAGCCCCAGCAGCCT

GTCTGCTAGCGTGGGCGACAGAGTGACCATCACCTGTAGAGCCAGCCAGAGCATCAGCAGCTACCTGAAC

TGGTATCAGCAGAAGCCCGGCAAGGCCCCCAAACTGCTGATCTACGCCGCCAGCTCTCTGCAGTCTGGCG

TGCCCAGCAGATTTTCCGGCAGCGGCTCTGGCACCGACTTCACCCTGACCATCAGCTCCCTGCAGCCCGA

GGACTTCGCCACCTACTACTGCCAGCAGGACAACGGCTACCCCAGCACCTTTGGCGGAGGTACCAAGGTG

GAAATCAAGCGTTGTGAGGCCACTCACAAGACATCAACTTCACCCATTGTCAAGAGCTTCAACAGGAATG

AGTGT] (SEQ ID NO: 138)

[spacer (SEQ ID NO: 923)][PL10-2001 LC (SEQ ID NO: 987)]
[QGQSGS][PCHPHPYDARPYCNVGGGSSGGSGGSGGIISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 139)

PL10-2001 LC nucleotide sequence
GGAGGTGGCTCGAGCGGTGGCAGCGGTGGCTCTGGTGGTATTAGCAGTGGTCTGTTAAGCGGTCGTAGCG

ATAATCATGGCGGTTCTGACATCCAGATGACCCAGAGCCCCAGCAGCCTGTCTGCTAGCGTGGGCGACAG

AGTGACCATCACCTGTAGAGCCAGCCAGAGCATCAGCAGCTACCTGAACTGGTATCAGCAGAAGCCCGGC

AAGGCCCCCAAACTGCTGATCTACGCCGCCAGCTCTCTGCAGTCTGGCGTGCCCAGCAGATTTTCCGGCA

GCGGCTCTGGCACCGACTTCACCCTGACCATCAGCTCCCTGCAGCCCGAGGACTTCGCCACCTACTACTG

CCAGCAGGACAACGGCTACCCCAGCACCTTTGGCGGAGGTACCAAGGTGGAAATCAAGCGTTGTGAGGCC

ACTCACAAGACATCAACTTCACCCATTGTCAAGAGCTTCAACAGGAATGAGTGT (SEQ ID

NO: 986)
PL10-2001 LC amino acid sequence
PCHPHPYDARPYCNVGGGSSGGSGGSGGIISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 987)

[spacer (SEQ ID NO: 923)] [PL11-2001 LC (SEQ ID NO: 1185)]
[QGQSGS][PCYWHPFFAYRYCNTGGGSSGGSGGSGGIISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1184)

PL11-2001 LC amino acid sequence
PCYWHPFFAYRYCNTGGGSSGGSGGSGGIISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 1185)

[spacer (SEQ ID NO: 923)] [PL12-2001 LC (SEQ ID NO: 1187)]
[QGQSGS][VCYYMDWLGRNWCSSGGGSSGGSGGSGGIISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1186)

PL12-2001 LC amino acid sequence
VCYYMDWLGRNWCSSGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 1187)

[spacer (SEQ ID NO: 929)] [PL14-2001 LC (SEQ ID NO: 988)]
[CAAGGTCAGTCTGGATCC][GGAGGTGGCTCGAGCGGTGGCAGCGGTGGCTCTGGTGGTATTAGCAGTG

GTCTGTTAAGCGGTCGTAGCGATAATCATGGCGGTTCTGACATCCAGATGACCCAGAGCCCCAGCAGCCT

GTCTGCTAGCGTGGGCGACAGAGTGACCATCACCTGTAGAGCCAGCCAGAGCATCAGCAGCTACCTGAAC

TGGTATCAGCAGAAGCCCGGCAAGGCCCCCAAACTGCTGATCTACGCCGCCAGCTCTCTGCAGTCTGGCG

TGCCCAGCAGATTTTCCGGCAGCGGCTCTGGCACCGACTTCACCCTGACCATCAGCTCCCTGCAGCCCGA

GGACTTCGCCACCTACTACTGCCAGCAGGACAACGGCTACCCCAGCACCTTTGGCGGAGGTACCAAGGTG

GAAATCAAGCGTTGTGAGGCCACTCACAAGACATCAACTTCACCCATTGTCAAGAGCTTCAACAGGAATG

AGTGT] (SEQ ID NO: 140)

[spacer (SEQ ID NO: 923)][PL14-2001 LC (SEQ ID NO: 989)]
[QGQSGS][YLPCHFVPIGACNNKGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFILTISSLQPEDFATYY

CQQDNGYPSTFGGGTKVEIKR] (SEQ ID NO: 141)

PL14-2001 LC nucleotide sequence
GGAGGTGGCTCGAGCGGTGGCAGCGGTGGCTCTGGTGGTATTAGCAGTGGTCTGTTAAGCGGTCGTAGCG

ATAATCATGGCGGTTCTGACATCCAGATGACCCAGAGCCCCAGCAGCCTGTCTGCTAGCGTGGGCGACAG

AGTGACCATCACCTGTAGAGCCAGCCAGAGCATCAGCAGCTACCTGAACTGGTATCAGCAGAAGCCCGGC

AAGGCCCCCAAACTGCTGATCTACGCCGCCAGCTCTCTGCAGTCTGGCGTGCCCAGCAGATTTTCCGGCA

GCGGCTCTGGCACCGACTTCACCCTGACCATCAGCTCCCTGCAGCCCGAGGACTTCGCCACCTACTACTG

CCAGCAGGACAACGGCTACCCCAGCACCTTTGGCGGAGGTACCAAGGTGGAAATCAAGCGTTGTGAGGCC

ACTCACAAGACATCAACTTCACCCATTGTCAAGAGCTTCAACAGGAATGAGTGT (SEQ ID NO: 988)

PL14-2001 LC amino acid sequence
YLPCHFVPIGACNNKGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 989)

[spacer (SEQ ID NO: 929)][PL15-2001 LC (SEQ ID NO: 990)]
[CAAGGTCAGTCTGGATCC][GGAGGTGGCTCGAGCGGTGGCAGCGGTGGCTCTGGTGGTATTAGCAGTG

GTCTGTTAAGCGGTCGTAGCGATAATCATGGCGGTTCTGACATCCAGATGACCCAGAGCCCCAGCAGCCT

GTCTGCTAGCGTGGGCGACAGAGTGACCATCACCTGTAGAGCCAGCCAGAGCATCAGCAGCTACCTGAAC

TGGTATCAGCAGAAGCCCGGCAAGGCCCCCAAACTGCTGATCTACGCCGCCAGCTCTCTGCAGTCTGGCG

TGCCCAGCAGATTTTCCGGCAGCGGCTCTGGCACCGACTTCACCCTGACCATCAGCTCCCTGCAGCCCGA

GGACTTCGCCACCTACTACTGCCAGCAGGACAACGGCTACCCCAGCACCTTTGGCGGAGGTACCAAGGTG

GAAATCAAGCGTTGTGAGGCCACTCACAAGACATCAACTTCACCCATTGTCAAGAGCTTCAACAGGAATG

AGTGT] (SEQ ID NO: 142)

[spacer (SEQ ID NO: 923)] [PL15-2001 LC (SEQ ID NO: 991)]
[QGQSGS][IFCHMGVVVPQCANYGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFILTISSLQPEDFATYY

CQQDNGYPSTFGGGTKVEIKR] (SEQ ID NO: 143)

PL15-2001 LC nucleotide sequence
GGAGGTGGCTCGAGCGGTGGCAGCGGTGGCTCTGGTGGTATTAGCAGTGGTCTGTTAAGCGGTCGTAGCG

ATAATCATGGCGGTTCTGACATCCAGATGACCCAGAGCCCCAGCAGCCTGTCTGCTAGCGTGGGCGACAG

AGTGACCATCACCTGTAGAGCCAGCCAGAGCATCAGCAGCTACCTGAACTGGTATCAGCAGAAGCCCGGC

AAGGCCCCCAAACTGCTGATCTACGCCGCCAGCTCTCTGCAGTCTGGCGTGCCCAGCAGATTTTCCGGCA

GCGGCTCTGGCACCGACTTCACCCTGACCATCAGCTCCCTGCAGCCCGAGGACTTCGCCACCTACTACTG

CCAGCAGGACAACGGCTACCCCAGCACCTTTGGCGGAGGTACCAAGGTGGAAATCAAGCGTTGTGAGGCC

ACTCACAAGACATCAACTTCACCCATTGTCAAGAGCTTCAACAGGAATGAGTGT (SEQ ID NO: 990)

PL15-2001 LC amino acid sequence
IFCHMGVVVPQCANYGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 991)

[spacer (SEQ ID NO: 929)][PL18-2001 LC (SEQ ID NO: 992)]
[CAAGGTCAGTCTGGATCC][GGAGGTGGCTCGAGCGGTGGCAGCGGTGGCTCTGGTGGTATTAGCAGTG

GTCTGTTAAGCGGTCGTAGCGATAATCATGGCGGTTCTGACATCCAGATGACCCAGAGCCCCAGCAGCCT

GTCTGCTAGCGTGGGCGACAGAGTGACCATCACCTGTAGAGCCAGCCAGAGCATCAGCAGCTACCTGAAC

TGGTATCAGCAGAAGCCCGGCAAGGCCCCCAAACTGCTGATCTACGCCGCCAGCTCTCTGCAGTCTGGCG

TGCCCAGCAGATTTTCCGGCAGCGGCTCTGGCACCGACTTCACCCTGACCATCAGCTCCCTGCAGCCCGA

GGACTTCGCCACCTACTACTGCCAGCAGGACAACGGCTACCCCAGCACCTTTGGCGGAGGTACCAAGGTG

GAAATCAAGCGTTGTGAGGCCACTCACAAGACATCAACTTCACCCATTGTCAAGAGCTTCAACAGGAATG

AGTGT] (SEQ ID NO: 144)

[spacer (SEQ ID NO: 923)] [PL18-2001 LC (SEQ ID NO: 993)]
[QGQSGS][PCHPHAYDARPYCNVGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 145)

PL18-2001 LC nucleotide sequence
GGAGGTGGCTCGAGCGGTGGCAGCGGTGGCTCTGGTGGTATTAGCAGTGGTCTGTTAAGCGGTCGTAGCG

ATAATCATGGCGGTTCTGACATCCAGATGACCCAGAGCCCCAGCAGCCTGTCTGCTAGCGTGGGCGACAG

AGTGACCATCACCTGTAGAGCCAGCCAGAGCATCAGCAGCTACCTGAACTGGTATCAGCAGAAGCCCGGC

AAGGCCCCCAAACTGCTGATCTACGCCGCCAGCTCTCTGCAGTCTGGCGTGCCCAGCAGATTTTCCGGCA

GCGGCTCTGGCACCGACTTCACCCTGACCATCAGCTCCCTGCAGCCCGAGGACTTCGCCACCTACTACTG

CCAGCAGGACAACGGCTACCCCAGCACCTTTGGCGGAGGTACCAAGGTGGAAATCAAGCGTTGTGAGGCC

ACTCACAAGACATCAACTTCACCCATTGTCAAGAGCTTCAACAGGAATGAGTGT (SEQ ID NO: 992)

PL18-2001 LC amino acid sequence
PCHPHAYDARPYCNVGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 993)

[spacer (SEQ ID NO: 923)][PL19-2001 LC (SEQ ID NO: 1189)]
[QGQSGS][PCHPHPADARPYCNVGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1188)

PL19-2001 LC amino acid sequence
PCHPHPADARPYCNVGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 1189)

[spacer (SEQ ID NO: 923)][PL20-2001 LC (SEQ ID NO: 1191)]
[QGQSGS][PCHPHPYAARPYCNVGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1190)

PL20-2001 LC amino acid sequence
PCHPHPYAARPYCNVGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 1191)

[spacer (SEQ ID NO: 929)][PL03-1004/GG/0001 (also referred to herein as
[CAAGGTCAGTCTGGATCC][GGAGGTGGCTCGAGCGGTGGCAGCGGTGCTGTGGGTCTCCTGGCTCCCC

CGGGCGGCCTGTCCGGCCGCAGCGATAATCATGGCGGTTCTGACATCCAGATGACCCAGAGCCCCAGCAG

CCTGTCTGCTAGCGTGGGCGACAGAGTGACCATCACCTGTAGAGCCAGCCAGAGCATCAGCAGCTACCTG

AACTGGTATCAGCAGAAGCCCGGCAAGGCCCCCAAACTGCTGATCTACGCCGCCAGCTCTCTGCAGTCTG

GCGTGCCCAGCAGATTTTCCGGCAGCGGCTCTGGCACCGACTTCACCCTGACCATCAGCTCCCTGCAGCC

CGAGGACTTCGCCACCTACTACTGCCAGCAGGACAACGGCTACCCCAGCACCTTTGGCGGAGGTACCAAG

GTGGAAATCAAGCGTTGTGAGGCCACTCACAAGACATCAACTTCACCCATTGTCAAGAGCTTCAACAGGA

ATGAGTGT] (SEQ ID NO: 146)

[spacer (SEQ ID NO: 923)] [PL03-1004/GG/0001 LC (SEQ ID NO: 995)]
[QGQSGS][LCEVLMLLQHPWCMGGGGSSGGSGGSGAVGLLAPPGGLSGRSDNHGGSDIQMTQSPSSLSASVG

DRVTITCRASQSISSYLNWYQQKPGKAPKLLIYAASSLQSGVPSRFSGSGSGTDFILTISSLQPEDFATY

YCQQDNGYPSTFGGGTKVEIKR] (SEQ ID NO: 147)

PL03-1004/GG/0001 LC nucleotide sequence
GGAGGTGGCTCGAGCGGTGGCAGCGGTGCTGTGGGTCTCCTGGCTCCCCCGGGCGGCCTGTCCGGCCGCA

GCGATAATCATGGCGGTTCTGACATCCAGATGACCCAGAGCCCCAGCAGCCTGTCTGCTAGCGTGGGCGA

CAGAGTGACCATCACCTGTAGAGCCAGCCAGAGCATCAGCAGCTACCTGAACTGGTATCAGCAGAAGCCC

GGCAAGGCCCCCAAACTGCTGATCTACGCCGCCAGCTCTCTGCAGTCTGGCGTGCCCAGCAGATTTTCCG

GCAGCGGCTCTGGCACCGACTTCACCCTGACCATCAGCTCCCTGCAGCCCGAGGACTTCGCCACCTACTA

CTGCCAGCAGGACAACGGCTACCCCAGCACCTTTGGCGGAGGTACCAAGGTGGAAATCAAGCGTTGTGAG

GCCACTCACAAGACATCAACTTCACCCATTGTCAAGAGCTTCAACAGGAATGAGTGT
(SEQ ID NO: 994)

PL03-1004/GG/0001 LC amino acid sequence
LCEVLMLLQHPWCMGGGGSSGGSGAVGLLAPPGGLSGRSDNHGGSDIQMIQSPSSLSASVGDRVTITCRA

SQSISSYLNWYQQKPGKAPKLLIYAASSLQSGVPSRFSGSGSGTDFTLTISSLQPEDFATYYCQQDNGYP

STFGGGTKVEIKR (SEQ ID NO: 995)

[spacer (SEQ ID NO: 929)] [PL06-1004/GG/0001 (also referred to herein
as PL06-3001) LC (SEQ ID NO: 996)]
[CAAGGTCAGTCTGGATCC][GGAGGTGGCTCGAGCGGTGGCAGCGGTGCTGTGGGTCTCCTGGCTCCCC

CGGGCGGCCTGTCCGGCCGCAGCGATAATCATGGCGGTTCTGACATCCAGATGACCCAGAGCCCCAGCAG

CCTGTCTGCTAGCGTGGGCGACAGAGTGACCATCACCTGTAGAGCCAGCCAGAGCATCAGCAGCTACCTG

AACTGGTATCAGCAGAAGCCCGGCAAGGCCCCCAAACTGCTGATCTACGCCGCCAGCTCTCTGCAGTCTG

GCGTGCCCAGCAGATTTTCCGGCAGCGGCTCTGGCACCGACTTCACCCTGACCATCAGCTCCCTGCAGCC

-continued

CGAGGACTTCGCCACCTACTACTGCCAGCAGGACAACGGCTACCCCAGCACCTTTGGCGGAGGTACCAAG

GTGGAAATCAAGCGTTGCGAAGTCACCCATCAGGGCCTGAGCTCGCCCGTCACAAAGAGCTTCAACAGGG

GAGAGTGT] (SEQ ID NO: 148)

[spacer (SEQ ID NO: 923)] [PL06-1004/GG/0001 LC (SEQ ID NO: 997)]
[QGQSGS][ILYCDSWGAGCLTRPGGGSSGGSGAVGLLAPPGGLSGRSDNHGGSDIQMTQSPSSLSASVG

DRVTITCRASQSISSYLNWYQQKPGKAPKLLIYAASSLQSGVPSRFSGSGSGTDFTLTISSLQPEDFATY

YCQQDNGYPSTFGGGTKVEIKR] (SEQ ID NO: 149)

PL06-1004/GG/0001 LC nucleotide sequence
GGAGGTGGCTCGAGCGGTGGCAGCGGTGCTGTGGGTCTCCTGGCTCCCCGGGCGGCCTGTCCGGCCGCA

GCGATAATCATGGCGGTTCTGACATCCAGATGACCCAGAGCCCCAGCAGCCTGTCTGCTAGCGTGGGCGA

CAGAGTGACCATCACCTGTAGAGCCAGCCAGAGCATCAGCAGCTACCTGAACTGGTATCAGCAGAAGCCC

GGCAAGGCCCCCAAACTGCTGATCTACGCCGCCAGCTCTCTGCAGTCTGGCGTGCCCAGCAGATTTTCCG

GCAGCGGCTCTGGCACCGACTTCACCCTGACCATCAGCTCCCTGCAGCCCGAGGACTTCGCCACCTACTA

CTGCCAGCAGGACAACGGCTACCCCAGCACCTTTGGCGGAGGTACCAAGGTGGAAATCAAGCGTTGCGAA

GTCACCCATCAGGGCCTGAGCTCGCCCGTCACAAAGAGCTTCAACAGGGGAGAGTGT
(SEQ ID NO: 996)

PL06-1004/GG/0001 LC amino acid sequence
ILYCDSWGAGCLIRPGGGSSGGSGAVGLLAPPGGLSGRSDNHGGSDIQMIQSPSSLSASVGDRVTITCRA

SQSISSYLNWYQQKPGKAPKLLIYAASSLQSGVPSRFSGSGSGTDFTLTISSLQPEDFATYYCQQDNGYP

STFGGGTKVEIKR (SEQ ID NO: 997)

[spacer (SEQ ID NO: 929)][PL07-1004/GG/0001 (also referred to herein
as PL07-3001) LC (SEQ ID NO: 998)]
[CAAGGTCAGTCTGGATCC][GGAGGTGGCTCGAGCGGTGGCAGCGGTGCTGTGGGTCTCCTGGCTCCCC

CGGGCGGCCTGTCCGGCCGCAGCGATAATCATGGCGGTTCTGACATCCAGATGACCCAGAGCCCCAGCAG

CCTGTCTGCTAGCGTGGGCGACAGAGTGACCATCACCTGTAGAGCCAGCCAGAGCATCAGCAGCTACCTG

AACTGGTATCAGCAGAAGCCCGGCAAGGCCCCCAAACTGCTGATCTACGCCGCCAGCTCTCTGCAGTCTG

GCGTGCCCAGCAGATTTTCCGGCAGCGGCTCTGGCACCGACTTCACCCTGACCATCAGCTCCCTGCAGCC

CGAGGACTTCGCCACCTACTACTGCCAGCAGGACAACGGCTACCCCAGCACCTTTGGCGGAGGTACCAAG

GTGGAAATCAAGCGTTGCGAAGTCACCCATCAGGGCCTGAGCTCGCCCGTCACAAAGAGCTTCAACAGGG

GAGAGTGT] (SEQ ID NO: 150)

[spacer (SEQ ID NO: 923)][PL01-1004/GG/0001 LC (SEQ ID NO: 999)]
[QGQSGS][GIALCPSHFCQLPQTGGGSSGGSGAVGLLAPPGGLSGRSDNHGGSDIQMTQSPSSLSASVG

DRVTITCRASQSISSYLNWYQQKPGKAPKLLIYAASSLQSGVPSRFSGSGSGTDFTLTISSLQPEDFATY

YCQQDNGYPSTFGGGTKVEIKR] (SEQ ID NO: 151)

PL07-1004/GG/0001 LC nucleotide sequence
GGAGGTGGCTCGAGCGGTGGCAGCGGTGCTGTGGGTCTCCTGGCTCCCCGGGCGGCCTGTCCGGCCGCA

GCGATAATCATGGCGGTTCTGACATCCAGATGACCCAGAGCCCCAGCAGCCTGTCTGCTAGCGTGGGCGA

CAGAGTGACCATCACCTGTAGAGCCAGCCAGAGCATCAGCAGCTACCTGAACTGGTATCAGCAGAAGCCC

GGCAAGGCCCCCAAACTGCTGATCTACGCCGCCAGCTCTCTGCAGTCTGGCGTGCCCAGCAGATTTTCCG

GCAGCGGCTCTGGCACCGACTTCACCCTGACCATCAGCTCCCTGCAGCCCGAGGACTTCGCCACCTACTA

CTGCCAGCAGGACAACGGCTACCCCAGCACCTTTGGCGGAGGTACCAAGGTGGAAATCAAGCGTTGCGAA

GTCACCCATCAGGGCCTGAGCTCGCCCGTCACAAAGAGCTTCAACAGGGGAGAGTGT
(SEQ ID NO: 998)

-continued

PL07-1004/GG/0001 LC amino acid sequence
GIALCPSHFCQLPQTGGGSSGGSGAVGLLAPPGGLSGRSDNHGGSDIQMIQSPSSLSASVGDRVTITCRA

SQSISSYLNWYQQKPGKAPKLLIYAASSLQSGVPSRFSGSGSGTDFTLTISSLQPEDFATYYCQQDNGYP

STFGGGTKVEIKR (SEQ ID NO: 999)

[spacer (SEQ ID NO: 929)][PL14-1004/GG/0001 (also referred to herein
as PL14-3001) LC (SEQ ID NO: 1000)]
[CAAGGTCAGTCTGGATCC][GGAGGTGGCTCGAGCGGTGGCAGCGGTGCTGTGGGTCTCCTGGCTCCCC

CGGGCGGCCTGTCCGGCCGCAGCGATAATCATGGCGGTTCTGACATCCAGATGACCCAGAGCCCCAGCAG

CCTGTCTGCTAGCGTGGGCGACAGAGTGACCATCACCTGTAGAGCCAGCCAGAGCATCAGCAGCTACCTG

AACTGGTATCAGCAGAAGCCCGGCAAGGCCCCCAAACTGCTGATCTACGCCGCCAGCTCTCTGCAGTCTG

GCGTGCCCAGCAGATTTTCCGGCAGCGGCTCTGGCACCGACTTCACCCTGACCATCAGCTCCCTGCAGCC

CGAGGACTTCGCCACCTACTACTGCCAGCAGGACAACGGCTACCCCAGCACCTTTGGCGGAGGTACCAAG

GTGGAAATCAAGCGTTGCGAAGTCACCCATCAGGGCCTGAGCTCGCCCGTCACAAAGAGCTTCAACAGGG

GAGAGTGT] (SEQ ID NO: 152)

[spacer (SEQ ID NO: 923)] [PL14-1004/GG/0001 LC (SEQ ID NO: 1001)]
[QGQSGS][YLPCHFVPIGACNNKGGGSSGGSGAVGLLAPPGGLSGRSDNHGGSDIQMTQSPSSLSASVG

DRVTITCRASQSISSYLNWYQQKPGKAPKLLIYAASSLQSGVPSRFSGSGSGTDFTLTISSLQPEDFATY

YCQQDNGYPSTFGGGTKVEIKR] (SEQ ID NO: 153)

PL14-1004/GG/0001 LC nucleotide sequence
GGAGGTGGCTCGAGCGGTGGCAGCGGTGCTGTGGGTCTCCTGGCTCCCCCGGGCGGCCTGTCCGGCCGCA

GCGATAATCATGGCGGTTCTGACATCCAGATGACCCAGAGCCCCAGCAGCCTGTCTGCTAGCGTGGGCGA

CAGAGTGACCATCACCTGTAGAGCCAGCCAGAGCATCAGCAGCTACCTGAACTGGTATCAGCAGAAGCCC

GGCAAGGCCCCCAAACTGCTGATCTACGCCGCCAGCTCTCTGCAGTCTGGCGTGCCCAGCAGATTTTCCG

GCAGCGGCTCTGGCACCGACTTCACCCTGACCATCAGCTCCCTGCAGCCCGAGGACTTCGCCACCTACTA

CTGCCAGCAGGACAACGGCTACCCCAGCACCTTTGGCGGAGGTACCAAGGTGGAAATCAAGCGTTGCGAA

GTCACCCATCAGGGCCTGAGCTCGCCCGTCACAAAGAGCTTCAACAGGGGAGAGTGT
(SEQ ID NO: 1000)

PL14-1004/GG/0001 LC amino acid sequence
YLPCHFVPIGACNNKGGGSSGGSGAVGLLAPPGGLSGRSDNHGGSDIQMIQSPSSLSASVGDRVTITCRA

SQSISSYLNWYQQKPGKAPKLLIYAASSLQSGVPSRFSGSGSGTDFTLTISSLQPEDFATYYCQQDNGYP

STFGGGTKVEIKR (SEQ ID NO: 1001)

[spacer (SEQ ID NO: 929)][PL15-1004/GG/0001 (also referred to herein
as PL15-3001) LC (SEQ ID NO: 1002)]
[CAAGGTCAGTCTGGATCC][GGAGGTGGCTCGAGCGGTGGCAGCGGTGCTGTGGGTCTCCTGGCTCCCC

CGGGCGGCCTGTCCGGCCGCAGCGATAATCATGGCGGTTCTGACATCCAGATGACCCAGAGCCCCAGCAG

CCTGTCTGCTAGCGTGGGCGACAGAGTGACCATCACCTGTAGAGCCAGCCAGAGCATCAGCAGCTACCTG

AACTGGTATCAGCAGAAGCCCGGCAAGGCCCCCAAACTGCTGATCTACGCCGCCAGCTCTCTGCAGTCTG

GCGTGCCCAGCAGATTTTCCGGCAGCGGCTCTGGCACCGACTTCACCCTGACCATCAGCTCCCTGCAGCC

CGAGGACTTCGCCACCTACTACTGCCAGCAGGACAACGGCTACCCCAGCACCTTTGGCGGAGGTACCAAG

GTGGAAATCAAGCGTTGTGAGGCCACTCACAAGACATCAACTTCACCCATTGTCAAGAGCTTCAACAGGA

ATGAGTGT] (SEQ ID NO: 154)

[spacer (SEQ ID NO: 923)] [PL15-1004/GG/0001 LC (SEQ ID NO: 1003)]
[QGQSGS][IFCHMGVVVPQCANYGGGSSGGSGAVGLLAPPGGLSGRSDNHGGSDIQMTQSPSSLSASVG

DRVTITCRASQSISSYLNWYQQKPGKAPKLLIYAASSLQSGVPSRFSGSGSGTDFTLTISSLQPEDFATY

YCQQDNGYPSTFGGGTKVEIKR] (SEQ ID NO: 155)

-continued

PL15-1004/GG/0001 LC nucleotide sequence
GGAGGTGGCTCGAGCGGTGGCAGCGGTGCTGTGGGTCTCCTGGCTCCCCGGGCGGCCTGTCCGGCCGCA

GCGATAATCATGGCGGTTCTGACATCCAGATGACCCAGAGCCCCAGCAGCCTGTCTGCTAGCGTGGGCGA

CAGAGTGACCATCACCTGTAGAGCCAGCCAGAGCATCAGCAGCTACCTGAACTGGTATCAGCAGAAGCCC

GGCAAGGCCCCCAAACTGCTGATCTACGCCGCCAGCTCTCTGCAGTCTGGCGTGCCCAGCAGATTTTCCG

GCAGCGGCTCTGGCACCGACTTCACCCTGACCATCAGCTCCCTGCAGCCCGAGGACTTCGCCACCTACTA

CTGCCAGCAGGACAACGGCTACCCCAGCACCTTTGGCGGAGGTACCAAGGTGGAAATCAAGCGTTGTGAG

GCCACTCACAAGACATCAACTTCACCCATTGTCAAGAGCTTCAACAGGAATGAGTGT
(SEQ ID NO: 1002)

PL15-1004/GG/0001 LC amino acid sequence
IFCHMGVVVPQCANYGGGSSGGSGAVGLLAPPGGLSGRSDNHGGSDIQMIQSPSSLSASVGDRVTITCRA

SQSISSYLNWYQQKPGKAPKLLIYAASSLQSGVPSRFSGSGSGTDFTLTISSLQPEDFATYYCQQDNGYP

STFGGGTKVEIKR (SEQ ID NO: 1003)

[spacer (SEQ ID NO: 929)] [PL18-1004/GG/0001 (also referred to herein
as PL18-3001) LC (SEQ ID NO: 1004)]
[CAAGGTCAGTCTGGATCC][GGAGGTGGCTCGAGCGGTGGCAGCGGTGCTGTGGGTCTCCTGGCTCCCC

CGGGCGGCCTGTCCGGCCGCAGCGATAATCATGGCGGTTCTGACATCCAGATGACCCAGAGCCCCAGCAG

CCTGTCTGCTAGCGTGGGCGACAGAGTGACCATCACCTGTAGAGCCAGCCAGAGCATCAGCAGCTACCTG

AACTGGTATCAGCAGAAGCCCGGCAAGGCCCCCAAACTGCTGATCTACGCCGCCAGCTCTCTGCAGTCTG

GCGTGCCCAGCAGATTTTCCGGCAGCGGCTCTGGCACCGACTTCACCCTGACCATCAGCTCCCTGCAGCC

CGAGGACTTCGCCACCTACTACTGCCAGCAGGACAACGGCTACCCCAGCACCTTTGGCGGAGGTACCAAG

GTGGAAATCAAGCGTTGTGAGGCCACTCACAAGACATCAACTTCACCCATTGTCAAGAGCTTCAACAGGA

ATGAGTGT] (SEQ ID NO: 156)

[spacer (SEQ ID NO: 923)] [PL18-1004/GG/0001 LC (SEQ ID NO: 1005)]
[QGQSGS][PCHPHAYDARPYCNVGGGSSGGSGAVGLLAPPGGLSGRSDNHGGSDIQMTQSPSSLSASVG

DRVTITCRASQSISSYLNWYQQKPGKAPKLLIYAASSLQSGVPSRFSGSGSGTDFTLTISSLQPEDFATY

YCQQDNGYPSTFGGGTKVEIKR] (SEQ ID NO: 157)

PL18-1004/GG/0001 LC nucleotide sequence
GGAGGTGGCTCGAGCGGTGGCAGCGGTGCTGTGGGTCTCCTGGCTCCCCGGGCGGCCTGTCCGGCCGCA

GCGATAATCATGGCGGTTCTGACATCCAGATGACCCAGAGCCCCAGCAGCCTGTCTGCTAGCGTGGGCGA

CAGAGTGACCATCACCTGTAGAGCCAGCCAGAGCATCAGCAGCTACCTGAACTGGTATCAGCAGAAGCCC

GGCAAGGCCCCCAAACTGCTGATCTACGCCGCCAGCTCTCTGCAGTCTGGCGTGCCCAGCAGATTTTCCG

GCAGCGGCTCTGGCACCGACTTCACCCTGACCATCAGCTCCCTGCAGCCCGAGGACTTCGCCACCTACTA

CTGCCAGCAGGACAACGGCTACCCCAGCACCTTTGGCGGAGGTACCAAGGTGGAAATCAAGCGTTGTGAG

GCCACTCACAAGACATCAACTTCACCCATTGTCAAGAGCTTCAACAGGAATGAGTGT
(SEQ ID NO: 1004)

PL18-1004/GG/0001 LC amino acid sequence
PCHPHAYDARPYCNVGGGSSGGSGAVGLLAPPGGLSGRSDNHGGSDIQMTQSPSSLSASVGDRVTITCRA

SQSISSYLNWYQQKPGKAPKLLIYAASSLQSGVPSRFSGSGSGTDFTLTISSLQPEDFATYYCQQDNGYP

STFGGGTKVEIKR (SEQ ID NO: 1005)

PL07-0001
[spacer (SEQ ID NO: 923)][PL07-0001 LC (SEQ ID NO: 1145)]
[QGQSGS][GIALCPSHFCQLPQTGGGSSGGSGGSGGLSGRSDNHGGSDIQMTQSPSSLSASVGDRVTIT

CRASQSISSYLNWYQQKPGKAPKLLIYAASSLQSGVPSRFSGSGSGTDFTLTISSLQPEDFATYYCQQDN

GYPSTFGGGTKVEIKR] (SEQ ID NO: 1144)

PL07-0001 LC amino acid sequence
GIALCPSHFCQLPQTGGGSSGGSGGSGGLSGRSDNHGGSDIQMTQSPSSLSASVGDRVTITCRASQSISS

YLNWYQQKPGKAPKLLIYAASSLQSGVPSRFSGSGSGTDFTLTISSLQPEDFATYYCQQDNGYPSTFGGG

TKVEIKR (SEQ ID NO: 1145)

PL07-0002
[spacer (SEQ ID NO: 923)][PL07-0002 LC (SEQ ID NO: 1147)]
[QGQSGS][GIALCPSHFCQLPQTGGGSSGGSGGSGGLSGRSGNHGGSDIQMTQSPSSLSASVGDRVTIT

CRASQSISSYLNWYQQKPGKAPKLLIYAASSLQSGVPSRFSGSGSGTDFTLTISSLQPEDFATYYCQQDN

GYPSTFGGGTKVEIKR] (SEQ ID NO: 1146)

PL07-0002 LC amino acid sequence
GIALCPSHFCQLPQTGGGSSGGSGGSGGLSGRSGNHGGSDIQMTQSPSSLSASVGDRVTITCRASQSISS

YLNWYQQKPGKAPKLLIYAASSLQSGVPSRFSGSGSGTDFTLTISSLQPEDFATYYCQQDNGYPSTFGGG

TKVEIKR (SEQ ID NO: 1147)

PL07-1001
[spacer (SEQ ID NO: 923)][PL07-1001 LC (SEQ ID NO: 1149)]
[QGQSGS][GIALCPSHFCQLPQTGGGSSGGSGGSGGISSGLLSSGGSDIQMTQSPSSLSASVGDRVTIT

CRASQSISSYLNWYQQKPGKAPKLLIYAASSLQSGVPSRFSGSGSGTDFTLTISSLQPEDFATYYCQQDN

GYPSTFGGGTKVEIKR](SEQ ID NO: 1148)

PL07-1001 LC amino acid sequence
GIALCPSHFCQLPQTGGGSSGGSGGSGGISSGLLSSGGSDIQMTQSPSSLSASVGDRVTITCRASQSISS

YLNWYQQKPGKAPKLLIYAASSLQSGVPSRFSGSGSGTDFTLTISSLQPEDFATYYCQQDNGYPSTFGGG

TKVEIKR (SEQ ID NO: 1149)

PL07-1002
[spacer (SEQ ID NO: 923)][PL07-1002 LC (SEQ ID NO: 1151)]
[QGQSGS][GIALCPSHFCQLPQTGGGSSGGSGGSGGQNQALRMAGGSDIQMTQSPSSLSASVGDRVTIT

CRASQSISSYLNWYQQKPGKAPKLLIYAASSLQSGVPSRFSGSGSGTDFTLTISSLQPEDFATYYCQQDN

GYPSTFGGGTKVEIKR](SEQ ID NO: 1150)

PL07-1002 LC amino acid sequence
GIALCPSHFCQLPQTGGGSSGGSGGSGGQNQALRMAGGSDIQMTQSPSSLSASVGDRVTITCRASQSISS

YLNWYQQKPGKAPKLLIYAASSLQSGVPSRFSGSGSGTDFTLTISSLQPEDFATYYCQQDNGYPSTFGGG

TKVEIKR (SEQ ID NO: 1151)

PL07-1003
[spacer (SEQ ID NO: 923)][PL07-1003 LC (SEQ ID NO: 1153)]
[QGQSGS][GIALCPSHFCQLPQTGGGSSGGSGGSGGVHMPLGFLGPGGSDIQMTQSPSSLSASVGDRVT

ITCRASQSISSYLNWYQQKPGKAPKLLIYAASSLQSGVPSRFSGSGSGTDFTLTISSLQPEDFATYYCQQ

DNGYPSTFGGGTKVEIKR](SEQ ID NO: 1152)

PL07-1003 LC amino acid sequence
GIALCPSHFCQLPQTGGGSSGGSGGSGGVHMPLGFLGPGGSDIQMTQSPSSLSASVGDRVTITCRASQSI

SSYLNWYQQKPGKAPKLLIYAASSLQSGVPSRFSGSGSGTDFTLTISSLQPEDFATYYCQQDNGYPSTFG

GGTKVEIKR (SEQ ID NO: 1153)

PL07-1004
[spacer (SEQ ID NO: 923)] [PL07-1004 LC (SEQ ID NO: 1201)]
[QGQSGS][GIALCPSHFCQLPQTGGGSSGGSGGSGGAVGLLAPPGGSDIQMTQSPSSLSASVGDRVTIT

CRASQSISSYLNWYQQKPGKAPKLLIYAASSLQSGVPSRFSGSGSGTDFILTISSLQPEDFATYYCQQDN

GYPSTFGGGTKVEIKR](SEQ ID NO: 1200)

PL07-1004 LC amino acid sequence
GIALCPSHFCQLPQTGGGSSGGSGGSGGAVGLLAPPGGSDIQMTQSPSSLSASVGDRVTITCRASQSISS

YLNWYQQKPGKAPKLLIYAASSLQSGVPSRFSGSGSGTDFTLTISSLQPEDFATYYCQQDNGYPSTFGGG

TKVEIKR (SEQ ID NO: 1201)

-continued

PL07-2002
[spacer (SEQ ID NO: 923)] [PL07-2002 LC (SEQ ID NO: 1155)]
[QGQSGS][GIALCPSHFCQLPQTGGGSSGGSGGSGGISSGLLSGRSGNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1154)

PL07-2002 LC amino acid sequence
GIALCPSHFCQLPQTGGGSSGGSGGSGGISSGLLSGRSGNHGGSDIQMTQSPSSLSASVGDRVTITCRAS

QSISSYLNWYQQKPGKAPKLLIYAASSLQSGVPSRFSGSGSGTDFILTISSLQPEDFATYYCQQDNGYPS

TFGGGTKVEIKR (SEQ ID NO: 1155)

PL07-2003
[spacer (SEQ ID NO: 923)] [PL07-2003 LC (SEQ ID NO: 1157)]
[QGQSGS][GIALCPSHFCQLPQTGGGSSGGSGGSGGISSGLLSGRSANPRGGGSDIQMTQSPSSLSASV

GDRVTITCRASQSISSYLNWYQQKPGKAPKLLIYAASSLQSGVPSRFSGSGSGTDFTLTISSLQPEDFAT

YYCQQDNGYPSTFGGGTKVEIKR] (SEQ ID NO: 1156)

PL07-2003 LC amino acid sequence
GIALCPSHFCQLPQTGGGSSGGSGGSGGISSGLLSGRSANPRGGGSDIQMTQSPSSLSASVGDRVTITCR

ASQSISSYLNWYQQKPGKAPKLLIYAASSLQSGVPSRFSGSGSGTDFTLTISSLQPEDFATYYCQQDNGY

PSTFGGGTKVEIKR (SEQ ID NO: 1157)

PL07-2004
[spacer (SEQ ID NO: 923)][PL07-2004 LC (SEQ ID NO: 1159)]
[QGQSGS][GIALCPSHFCQLPQTGGGSSGGSGGSGGAVGLLAPPTSGRSANPRGGGSDIQMTQSPSSLS

ASVGDRVTITCRASQSISSYLNWYQQKPGKAPKLLIYAASSLQSGVPSRFSGSGSGTDFTLTISSLQPED

FATYYCQQDNGYPSTFGGGTKVEIKR] (SEQ ID NO: 1158)

PL07-2004 LC amino acid sequence
GIALCPSHFCQLPQTGGGSSGGSGGSGGAVGLLAPPTSGRSANPRGGGSDIQMTQSPSSLSASVGDRVTI

TCRASQSISSYLNWYQQKPGKAPKLLIYAASSLQSGVPSRFSGSGSGTDFTLTISSLQPEDFATYYCQQD

NGYPSTFGGGTKVEIKR (SEQ ID NO: 1159)

PL07-2005
[spacer (SEQ ID NO: 923)][PL07-2005 LC (SEQ ID NO: 1161)]
[QGQSGS][GIALCPSHFCQLPQTGGGSSGGSGGSGGAVGLLAPPSGRSANPRGGGSDIQMTQSPSSLSA

SVGDRVTITCRASQSISSYLNWYQQKPGKAPKLLIYAASSLQSGVPSRFSGSGSGTDFTLTISSLQPEDF

ATYYCQQDNGYPSTFGGGTKVEIKR] (SEQ ID NO: 1160)

PL07-2005 LC amino acid sequence
GIALCPSHFCQLPQTGGGSSGGSGGSGGAVGLLAPPSGRSANPRGGGSDIQMTQSPSSLSASVGDRVTIT

CRASQSISSYLNWYQQKPGKAPKLLIYAASSLQSGVPSRFSGSGSGTDFTLTISSLQPEDFATYYCQQDN

GYPSTFGGGTKVEIKR (SEQ ID NO: 1161)

PL07-2006
[spacer (SEQ ID NO: 923)][PL07-2006 LC (SEQ ID NO: 1163)]
[QGQSGS][GIALCPSHFCQLPQTGGGSSGGSGGSGGISSGLLSGRSDDHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR](SEQ ID NO: 1162)

PL07-2006 LC amino acid sequence
GIALCPSHFCQLPQTGGGSSGGSGGSGGISSGLLSGRSDDHGGSDIQMIQSPSSLSASVGDRVTITCRAS

QSISSYLNWYQQKPGKAPKLLIYAASSLQSGVPSRFSGSGSGTDFILTISSLQPEDFATYYCQQDNGYPS

TFGGGTKVEIKR (SEQ ID NO: 1163)

PL07-2007
[spacer (SEQ ID NO: 923)] [PL07-2007 LC (SEQ ID NO: 1165)]
[QGQSGS][GIALCPSHFCQLPQTGGGSSGGSGGSGGISSGLLSGRSDIHGGSDIQMIQSPSSLSASVGD

RVTITCRASQSISSYLNWYQQKPGKAPKLLIYAASSLQSGVPSRFSGSGSGTDFILTISSLQPEDFATYY

CQQDNGYPSTFGGGTKVEIKR] (SEQ ID NO: 1164)

PL07-2007 LC amino acid sequence
GIALCPSHFCQLPQTGGGSSGGSGGSGGISSGLLSGRSDIHGGSDIQMIQSPSSLSASVGDRVTITCRAS

QSISSYLNWYQQKPGKAPKLLIYAASSLQSGVPSRFSGSGSGTDFILTISSLQPEDFATYYCQQDNGYPS

TFGGGTKVEIKR (SEQ ID NO: 1165)

PL07-2008
[spacer (SEQ ID NO: 923)] [PL07-2008 LC (SEQ ID NO: 1167)]
[QGQSGS][GIALCPSHFCQLPQTGGGSSGGSGGSGGISSGLLSGRSDQHGGSDIQMIQSPSSLSASVGD

RVTITCRASQSISSYLNWYQQKPGKAPKLLIYAASSLQSGVPSRFSGSGSGTDFILTISSLQPEDFATYY

CQQDNGYPSTFGGGTKVEIKR] (SEQ ID NO: 1166)

PL07-2008 LC amino acid sequence
GIALCPSHFCQLPQTGGGSSGGSGGSGGISSGLLSGRSDQHGGSDIQMIQSPSSLSASVGDRVTITCRAS

QSISSYLNWYQQKPGKAPKLLIYAASSLQSGVPSRFSGSGSGTDFILTISSLQPEDFATYYCQQDNGYPS

TFGGGTKVEIKR (SEQ ID NO: 1167)

PL07-2009
[spacer (SEQ ID NO: 923)] [PL07-2009 LC (SEQ ID NO: 1169)]
[QGQSGS][GIALCPSHFCQLPQTGGGSSGGSGGSGGISSGLLSGRSDTHGGSDIQMIQSPSSLSASVGD

RVTITCRASQSISSYLNWYQQKPGKAPKLLIYAASSLQSGVPSRFSGSGSGTDFILTISSLQPEDFATYY

CQQDNGYPSTFGGGTKVEIKR] (SEQ ID NO: 1168)

PL07-2009 LC amino acid sequence
GIALCPSHFCQLPQTGGGSSGGSGGSGGISSGLLSGRSDTHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 1169)

PL07-2010
[spacer (SEQ ID NO: 923)] [PL07-2010 LC (SEQ ID NO: 1171)]
[QGQSGS][GIALCPSHFCQLPQTGGGSSGGSGGSGGISSGLLSGRSDYHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1170)

PL07-2010 LC amino acid sequence
GIALCPSHFCQLPQTGGGSSGGSGGSGGISSGLLSGRSDYHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 1171)

PL07-2011
[spacer (SEQ ID NO: 923)] [PL07-2011 LC (SEQ ID NO: 1173)]
[QGQSGS][GIALCPSHFCQLPQTGGGSSGGSGGSGGISSGLLSGRSDNPGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1172)

PL07-2011 LC amino acid sequence
GIALCPSHFCQLPQTGGGSSGGSGGSGGISSGLLSGRSDNPGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKR (SEQ ID NO: 1173)

PL07-2012
[spacer (SEQ ID NO: 923)] [PL07-2012 LC (SEQ ID NO: 1175)]
[QGQSGS][GIALCPSHFCQLPQTGGGSSGGSGGSGGISSGLLSGRSANPGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR] (SEQ ID NO: 1174)

PL07-2012 LC amino acid sequence
GIALCPSHFCQLPQTGGGSSGGSGGSGGISSGLLSGRSANPGGSDIQMIQSPSSLSASVGDRVTITCRAS

QSISSYLNWYQQKPGKAPKLLIYAASSLQSGVPSRFSGSGSGTDFILTISSLQPEDFATYYCQQDNGYPS

TFGGGTKVEIKR (SEQ ID NO: 1175)

PL07-2013
[spacer (SEQ ID NO: 923)] [PL07-2013 LC (SEQ ID NO: 1177)]
[QGQSGS][GIALCPSHFCQLPQTGGGSSGGSGGSGGISSGLLSGRSANIGGSDIQMIQSPSSLSASVGD

RVTITCRASQSISSYLNWYQQKPGKAPKLLIYAASSLQSGVPSRFSGSGSGTDFILTISSLQPEDFATYY

CQQDNGYPSTFGGGTKVEIKR] (SEQ ID NO: 1176)

PL07-2013 LC amino acid sequence
GIALCPSHFCQLPQTGGGSSGGSGGSGGISSGLLSGRSANIGGSDIQMIQSPSSLSASVGDRVTITCRAS

QSISSYLNWYQQKPGKAPKLLIYAASSLQSGVPSRFSGSGSGTDFILTISSLQPEDFATYYCQQDNGYPS

TFGGGTKVEIKR (SEQ ID NO: 1177)

PL07-2014
[spacer (SEQ ID NO: 923)][PL07-2014 LC (SEQ ID NO: 1179)]
[QGQSGS][GIALCPSHFCQLPQTGGGSSGGSGGSGGISSGLLSGRSDNIGGSDIQMIQSPSSLSASVGD

RVTITCRASQSISSYLNWYQQKPGKAPKLLIYAASSLQSGVPSRFSGSGSGTDFILTISSLQPEDFATYY

CQQDNGYPSTFGGGTKVEIKR] (SEQ ID NO: 1178)

PL07-2014 LC amino acid sequence
GIALCPSHFCQLPQTGGGSSGGSGGSGGISSGLLSGRSDNIGGSDIQMIQSPSSLSASVGDRVTITCRAS

QSISSYLNWYQQKPGKAPKLLIYAASSLQSGVPSRFSGSGSGTDFILTISSLQPEDFATYYCQQDNGYPS

TFGGGTKVEIKR (SEQ ID NO: 1179)

PL07-1004/GG/0003
[spacer (SEQ ID NO: 923)] [PL07-1004/GG/0003 LC (SEQ ID NO: 1181)]
[QGQSGS][GIALCPSHFCQLPQTGGGSSGGSGGSGGAVGLLAPPGGISTSGRSANPRGGGSDIQMIQSP

SSLSASVGDRVTITCRASQSISSYLNWYQQKPGKAPKLLIYAASSLQSGVPSRFSGSGSGTDFILTISSL

QPEDFATYYCQQDNGYPSTFGGGTKVEIKR] (SEQ ID NO: 1180)

PL07-1004/GG/0003 LC amino acid sequence
GIALCPSHFCQLPQTGGGSSGGSGGSGGAVGLLAPPGGTSTSGRSANPRGGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKR (SEQ ID NO: 1181)

Example 11. Anti-PDL1 Activatable Antibodies of the Disclosure

This example demonstrates that anti-PDL1 activatable antibodies can be made in a variety of combinations of MM, CM, VL, and VH domains as well as in a variety of distinct human isotypes.

TABLE 18

Anti-PDL1 Activatable Antibody Components

| Mask Sequence (MM) | Substrate Sequence (CM) | VL | VH |
|---|---|---|---|
| YCEVSELFVLPWCMG (SEQ ID NO: 208) | LSGRSDNH (SEQ ID NO: 341) | SEQ ID NO: 12 | SEQ ID NO: 14 |

TABLE 18-continued

Anti-PDL1 Activatable Antibody Components

| Mask Sequence (MM) | Substrate Sequence (CM) | VL | VH |
|---|---|---|---|
| SCLMHPHYAHDYCYV (SEQ ID NO: 426) | TGRGPSWV (SEQ ID NO: 338) | SEQ ID NO: 58 | SEQ ID NO: 16 |
| LCEVLMLLQHPWCMG (SEQ ID NO: 59) | PLTGRSGG (SEQ ID NO: 344) | | SEQ ID NO: 18 |
| IACRHFMEQLPFCHH (SEQ ID NO: 60) | TARGPSFK (SEQ ID NO: 340) | | SEQ ID NO: 20 |
| FGPRCGEASTCVPYE (SEQ ID NO: 61) | NTLSGRSENHSG (SEQ ID NO: 435) | | SEQ ID NO: 22 |
| ILYCDSWGAGCLTRP (SEQ ID NO: 62) | NTLSGRSGNHGS (SEQ ID NO: 436) | | SEQ ID NO: 24 |
| GIALCPSHFCQLPQT (SEQ ID NO: 63) | TSTSGRSANPRG (SEQ ID NO: 437) | | SEQ ID NO: 26 |
| DGPRCFVSGECSPIG (SEQ ID NO: 64) | TSGRSANP (SEQ ID NO: 438) | | SEQ ID NO: 28 |
| LCYKLDYDDRSYCHI (SEQ ID NO: 65) | VHMPLGFLGP (SEQ ID NO: 352) | | SEQ ID NO: 30 |
| PCHPHPYDARPYCNV (SEQ ID NO: 66) | AVGLLAPP (SEQ ID NO: 372) | | SEQ ID NO: 32 |
| PCYWHPFFAYRYCNT (SEQ ID NO: 67) | AQNLLGMV (SEQ ID NO: 360) | | SEQ ID NO: 34 |
| VCYYMDWLGRNWCSS (SEQ ID NO: 68) | QNQALRMA (SEQ ID NO: 359) | | SEQ ID NO: 36 |
| LCDLFKLREFPYCMG (SEQ ID NO: 69) | LAAPLGLL (SEQ ID NO: 371) | | SEQ ID NO: 38 |
| YLPCHFVPIGACNNK (SEQ ID NO: 70) | STFPFGMF (SEQ ID NO: 361) | | SEQ ID NO: 40 |
| IFCHMGVVVPQCANY (SEQ ID NO: 71) | ISSGLLSS (SEQ ID NO: 364) | | SEQ ID NO: 42 |
| ACHPHPYDARPYCNV (SEQ ID NO: 72) | PAGLWLDP (SEQ ID NO: 374) | | SEQ ID NO: 44 |
| PCHPAPYDARPYCNV (SEQ ID NO: 73) | VAGRSMRP (SEQ ID NO: 439) | | SEQ ID NO: 46 |
| PCHPHAYDARPYCNV (SEQ ID NO: 74) | VVPEGRRS (SEQ ID NO: 440) | | SEQ ID NO: 48 |
| PCHPHPADARPYCNV (SEQ ID NO: 75) | ILPRSPAF (SEQ ID NO: 441) | | SEQ ID NO: 50 |
| PCHPHPYAARPYCNV (SEQ ID NO: 76) | MVLGRSLL (SEQ ID NO: 442) | | SEQ ID NO: 52 |
| PCHPHPYDAAPYCNV (SEQ ID NO: 77) | QGRAITFI (SEQ ID NO: 443) | | SEQ ID NO: 54 |
| PCHPHPYDARPACNV (SEQ ID NO: 78) | SPRSIMLA (SEQ ID NO: 444) | | SEQ ID NO: 56 |
| PCHPHPYDARPYCAV (SEQ ID NO: 79) | SMLRSMPL (SEQ ID NO: 445) | | |
| PCHAHPYDARPYCNV (SEQ ID NO: 80) | ISSGLLSGRSDNH (SEQ ID NO: 377) | | |
| PCHPHPYDARAYCNV (SEQ ID NO: 81) | AVGLLAPPGGLSGRSDNH (SEQ ID NO: 383) | | |

TABLE 18-continued

Anti-PDL1 Activatable Antibody Components

| Mask Sequence (MM) | Substrate Sequence (CM) | VL | VH |
|---|---|---|---|
| | ISSGLLSSGGSGGSLSGRSDNH (SEQ ID NO: 378) | | |
| | LSGRSGNH (SEQ ID NO: 883) | | |
| | SGRSANPRG (SEQ ID NO: 884) | | |
| | LSGRSDDH (SEQ ID NO: 885) | | |
| | LSGRSDIH (SEQ ID NO: 886) | | |
| | LSGRSDQH (SEQ ID NO: 887) | | |
| | LSGRSDTH (SEQ ID NO: 888) | | |
| | LSGRSDYH (SEQ ID NO: 889) | | |
| | LSGRSDNP (SEQ ID NO: 890) | | |
| | LSGRSANP (SEQ ID NO: 891) | | |
| | LSGRSANI (SEQ ID NO: 892) | | |
| | LSGRSDNI (SEQ ID NO: 893) | | |
| | MIAPVAYR (SEQ ID NO: 894) | | |
| | RPSPMWAY (SEQ ID NO: 895) | | |
| | WATPRPMR (SEQ ID NO: 896) | | |
| | FRLLDWQW (SEQ ID NO: 897) | | |
| | ISSGL (SEQ ID NO: 898) | | |
| | ISSGLLS (SEQ ID NO: 899) | | |
| | ISSGLL (SEQ ID NO: 900) | | |
| | ISSGLLSGRSANPRG (SEQ ID NO: 901) | | |
| | AVGLLAPPTSGRSANPRG (SEQ ID NO: 902) | | |
| | AVGLLAPPSGRSANPRG (SEQ ID NO: 903) | | |
| | ISSGLLSGRSDDH (SEQ ID NO: 904) | | |
| | ISSGLLSGRSDIH (SEQ ID NO: 905) | | |
| | ISSGLLSGRSDQH (SEQ ID NO: 906) | | |

TABLE 18-continued

Anti-PDL1 Activatable Antibody Components

| Mask Sequence (MM) | Substrate Sequence (CM) | VL | VH |
|---|---|---|---|
| | ISSGLLSGRSDTH (SEQ ID NO: 907) | | |
| | ISSGLLSGRSDYH (SEQ ID NO: 908) | | |
| | ISSGLLSGRSDNP (SEQ ID NO: 909) | | |
| | ISSGLLSGRSANP (SEQ ID NO: 910) | | |
| | ISSGLLSGRSANI (SEQ ID NO: 911) | | |
| | AVGLLAPPGGLSGRSDDH (SEQ ID NO: 912) | | |
| | AVGLLAPPGGLSGRSDIH (SEQ ID NO: 913) | | |
| | AVGLLAPPGGLSGRSDQH (SEQ ID NO: 914) | | |
| | AVGLLAPPGGLSGRSDTH (SEQ ID NO: 915) | | |
| | AVGLLAPPGGLSGRSDYH (SEQ ID NO: 916) | | |
| | AVGLLAPPGGLSGRSDNP (SEQ ID NO: 917) | | |
| | AVGLLAPPGGLSGRSANP (SEQ ID NO: 918) | | |
| | AVGLLAPPGGLSGRSANI (SEQ ID NO: 919) | | |
| | ISSGLLSGRSDNI (SEQ ID NO: 920) | | |
| | AVGLLAPPGGLSGRSDNI (SEQ ID NO: 921) | | |
| | GLSGRSDNHGGAVGLLAPP (SEQ ID NO: 1009) | | |
| | GLSGRSDNHGGVHMPLGFLGP (SEQ ID NO: 1010) | | |

Any of the combinations described in Table 18 can be combined with human immunoglobulin constant regions to result in fully human IgGs including IgG1, IgG2, IgG4 or mutated constant regions to result in human IgGs with altered functions such as IgG1 N297A, IgG1 N297Q, or IgG4 S228P. The combinations described in Table 18 are not limited by the particular combinations shown in any given row and include any mask sequence from column 1 matched with any substrate sequence from column 2 matched with any VL sequence from column 3 matched with any VH sequence from column 4. In addition to the substrate sequences disclosed in column 2, any CM disclosed herein can be used.

As an example, a spacer sequence (SEQ ID NO: 923) and Mask SEQ ID NO: 63 can be combined with substrate ISSGLLSGRSDNH (SEQ ID NO: 377), VL SEQ ID NO: 58, and combined with human kappa constant domain to give SEQ ID NO: 428; or Mask SEQ ID NO: 63 can be combined with substrate ISSGLLSGRSDNH (SEQ ID NO: 377), VL SEQ ID NO: 58, and combined with human kappa constant domain to give SEQ ID NO: 1008. Furthermore, VH SEQ ID NO: 46 can be combined with human immunoglobulin heavy chain constant domains to give human IgG1 (SEQ ID NO: 430), mutated human IgG4 S228P (SEQ ID NO: 432), mutated human IgG1 N297A (SEQ ID NO: 434), or mutated human IgG1 N297Q (SEQ ID NO: 1202). Co-expression of SEQ ID NO: 427 with SEQ ID NO: 429 will yield a fully human IgG1 anti-PDL1 activatable antibody. Co-expression of SEQ ID NO: 427 with SEQ ID NO: 431 will yield a fully human IgG4S228P anti-PDL1 activatable antibody. Co-expression of SEQ ID NO: 427 with SEQ ID NO: 433 will yield a fully human IgG1 N297A anti-PDL1 activatable antibody. Co-expression of SEQ ID NO: 427 with a nucleic acid sequence encoding the amino acid sequence of SEQ ID NO: 1202 will yield a fully human IgG1 N297Q anti-PDL1 activatable antibody.

[Light chain sequence (SEQ ID NO: 1007) with spacer (SEQ ID NO: 1006)]
(SEQ ID NO: 427)

(SEQ ID NO: 427)

[CAGGGCCAGTCCGGCTCA][TATCTGCCCTGCCACTTCGTGCCAATCGGGGCCTGTAACAATAAGGGCG

GTGGATCTAGTGGTGGCTCAGGCGGGTCTGGCGGCATTTCCAGTGGACTCTTGTCAGGACGATCCGATAA

TCATGGCGGGTCCGACATCCAGATGACACAGAGCCCTTCTTCCCTCTCCGCAAGCGTTGGCGACAGGGTC

ACCATTACCTGTAGGGCTTCTCAGAGCATCTCAAGCTATCTGAACTGGTACCAGCAGAAACCTGGAAAGG

CTCCAAAACTGCTGATTTACGCTGCCTCCAGTCTTCAGTCAGGCGTCCCCTCCAGATTTAGCGGATCAGG

TAGTGGAACTGATTTTACCCTTACAATATCTTCTCTGCAGCCAGAGGACTTCGCCACATACTATTGTCAG

CAAGACAATGGTTACCCCAGTACATTTGGCGGAGGGACAAAGGTCGAGATCAAAAGGACCGTAGCAGCAC

CAAGCGTCTTTATTTTCCCCCCCAGTGACGAACAGCTGAAGAGCGGAACAGCTTCAGTGGTGTGTCTCCT

GAATAACTTCTATCCACGCGAGGCAAAGGTGCAGTGGAAGGTGGACAATGCACTGCAGTCTGGTAATTCC

CAAGAAAGTGTTACTGAGCAGGATTCCAAGGATTCAACTTACTCTCTGTCTAGCACCCTGACTCTTTCTA

AAGCAGATTATGAGAAGCATAAGGTCTACGCTTGCGAGGTGACCCACCAGGGGCTTTCCTCTCCAGTTAC

CAAGTCATTCAACCGGGGTGAGTGTTGATGAGAATTC]

Light chain sequence without spacer (SEQ ID NO: 1007)

TATCTGCCCTGCCACTTCGTGCCAATCGGGGCCTGTAACAATAAGGGCGGTGGATCTAGTGGTGGCTCAG

GCGGGTCTGGCGGCATTTCCAGTGGACTCTTGTCAGGACGATCCGATAATCATGGCGGGTCCGACATCCA

GATGACACAGAGCCCTTCTTCCCTCTCCGCAAGCGTTGGCGACAGGGTCACCATTACCTGTAGGGCTTCT

CAGAGCATCTCAAGCTATCTGAACTGGTACCAGCAGAAACCTGGAAAGGCTCCAAAACTGCTGATTTACG

CTGCCTCCAGTCTTCAGTCAGGCGTCCCCTCCAGATTTAGCGGATCAGGTAGTGGAACTGATTTTACCCT

TACAATATCTTCTCTGCAGCCAGAGGACTTCGCCACATACTATTGTCAGCAAGACAATGGTTACCCCAGT

ACATTTGGCGGAGGGACAAAGGTCGAGATCAAAAGGACCGTAGCAGCACCAAGCGTCTTTATTTTCCCCC

CCAGTGACGAACAGCTGAAGAGCGGAACAGCTTCAGTGGTGTGTCTCCTGAATAACTTCTATCCACGCGA

GGCAAAGGTGCAGTGGAAGGTGGACAATGCACTGCAGTCTGGTAATTCCCAAGAAAGTGTTACTGAGCAG

GATTCCAAGGATTCAACTTACTCTCTGTCTAGCACCCTGACTCTTTCTAAAGCAGATTATGAGAAGCATA

AGGTCTACGCTTGCGAGGTGACCCACCAGGGGCTTTCCTCTCCAGTTACCAAGTCATTCAACCGGGGTGA

GTGTTGATGAGAATTC

[Light chain sequence (SEQ ID NO 1008) with spacer (SEQ ID NO: 92)]
(SEQ ID NO: 428)

(SEQ ID NO: 428)

[QGQSGS][GIALCPSHFCQLPQTGGGSSGGSGGSGGISSGLLSGRSDNHGGSDIQMTQSPSSLSASVGD

RVTITCRASQSISSYLNWYQQKPGKAPKLLIYAASSLQSGVPSRFSGSGSGTDFTLTISSLQPEDFATYY

CQQDNGYPSTFGGGTKVEIKRTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTKSFNRGEC]

Light chain sequence without spacer (SEQ ID NO: 1008)

GIALCPSHFCQLPQTGGGSSGGSGGSGGISSGLLSGRSDNHGGSDIQMTQSPSSLSASVGDRVTITCRAS

QSISSYLNWYQQKPGKAPKLLIYAASSLQSGVPSRFSGSGSGTDFTLTISSLQPEDFATYYCQQDNGYPS

TFGGGTKVEIKRTVAAPSVFIFPPSDEQLKSGTASVVCLLNNFYPREAKVQWKVDNALQSGNSQESVTEQ

DSKDSTYSLSSTLTLSKADYEKHKVYACEVTHQGLSSPVTKSFNRGEC

SEQ ID NO: 429

GAAGTGCAGCTGCTCGAAAGCGGCGGAGGCTTGGTGCAGCCAGGAGGGAGCCTGCGACTGTCTTGCGCAG

CCAGCGGATTCACTTTCTCTTCCTATGCCATGAGCTGGGTTCGACAGGCACCCGGCAAAGGTCTCGAGTG

GGTGTCTAGCATCTGGCGAAACGGAATAGTTACAGTGTATGCCGATAGCGTGAAGGGTCGCTTTACTATT

-continued

```
TCACGGGATAATTCTAAGAACACCCTCTACCTGCAAATGAATAGCCTTAGGGCAGAAGATACCGCCGTGT
ACTACTGTGCCAAATGGTCCGCAGCCTTTGACTACTGGGGCCAGGGGACACTGGTGACCGTGTCCTCTGC
ATCAACCAAGGGGCCATCAGTGTTCCCACTCGCCCCATCTTCCAAGAGTACTTCCGGCGGAACCGCAGCC
CTTGGCTGCCTTGTTAAGGACTATTTCCCAGAACCCGTGACCGTAAGTTGGAACTCTGGCGCCCTTACTT
CTGGGGTGCACACCTTCCCAGCAGTGTTGCAGTCCAGTGGCCTTTACTCTCTGTCTAGTGTAGTGACTGT
GCCTTCCTCTAGTCTCGGTACCCAGACCTATATTTGTAATGTTAACCATAAGCCCAGCAATACAAAGGTT
GATAAGAAAGTGGAACCCAAGAGCTGCGATAAGACACATACCTGCCCACCTTGTCCAGCTCCCGAGCTGC
TGGGCGGACCCTCAGTCTTTCTCTTCCCACCTAAACCCAAGGATACCCTTATGATCTCCAGGACTCCTGA
GGTGACCTGCGTTGTGGTCGACGTGTCACATGAGGACCCTGAGGTAAAGTTTAACTGGTACGTGGACGGT
GTGGAGGTACATAACGCTAAGACTAAGCCACGAGAGGAGCAATACGCTTCCACTTACAGGGTGGTCAGCG
TCCTGACCGTTCTCCATCAGGACTGGCTGAACGGGAAGGAATATAAGTGTAAGGTTAGCAACAAAGCTCT
CCCTGCACCAATCGAGAAGACAATCAGCAAGGCAAAAGGGCAGCCTCGGGAACCTCAGGTCTACACCCTC
CCTCCTAGCAGGGAAGAGATGACAAAGAACCAGGTCTCTCTCACCTGCCTGGTGAAAGGCTTCTATCCAT
CTGACATTGCTGTGGAGTGGGAATCCAACGGCCAGCCTGAAAATAATTATAAGACCACACCCCCCGTCCT
TGATTCCGATGGATCTTTCTTCCTGTACAGTAAACTCACCGTCGACAAATCACGGTGGCAGCAAGGTAAC
GTGTTCAGCTGTTCTGTCATGCATGAGGCTCTGCATAACCATTACACACAAAAGTCTTTGTCATTGTCTC
CAGGATGATGAGAATTCATTGATCATAATCAGCCATACCAC
```

SEQ ID NO: 430

```
EVQLLESGGGLVQPGGSLRLSCAASGFTFSSYAMSWVRQAPGKGLEWVSSIWRNGIVTVYADSVKGRFTI
SRDNSKNTLYLQMNSLRAEDTAVYYCAKWSAAFDYWGQGTLVTVSSASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKV
DKKVEPKSCDKTHTCPPCPAPELLGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALPAPIEKTISKAKGQPREPQVYTL
PPSREEMTKNQVSLTCLVKGFYPSDIAVEWESNGQPENNYKTTPPVLDSDGSFFLYSKLTVDKSRWQQGN
VFSCSVMHEALHNHYTQKSLSLSPG
```

SEQ ID NO: 431

```
GAAGTGCAGCTGCTCGAAAGCGGCGGAGGCTTGGTGCAGCCAGGAGGGAGCCTGCGACTGTCTTGCGCAG
CCAGCGGATTCACTTTCTCTTCCTATGCCATGAGCTGGGTTCGACAGGCACCCGGCAAAGGTCTCGAGTG
GGTGTCTAGCATCTGGCGAAACGGAATAGTTACAGTGTATGCCGATAGCGTGAAGGGTCGCTTTACTATT
TCACGGGATAATTCTAAGAACACCCTCTACCTGCAAATGAATAGCCTTAGGGCAGAAGATACCGCCGTGT
ACTACTGTGCCAAATGGTCCGCAGCCTTTGACTACTGGGGCCAGGGGACACTGGTGACCGTGTCCTCTGC
ATCAACCAAGGGGCCATCAGTGTTCCCACTCGCCCCATGTAGCAGATCAACATCTGAATCCACCGCAGCC
CTTGGCTGCCTTGTTAAGGACTATTTCCCAGAACCCGTGACCGTAAGTTGGAACTCTGGCGCCCTTACTT
CTGGGGTGCACACCTTCCCAGCAGTGTTGCAGTCCAGTGGCCTTTACTCTCTGTCTAGTGTAGTGACTGT
GCCTTCCTCTAGTCTCGGTACCAAGACCTATACCTGCAACGTAGATCATAAGCCCAGCAATACAAAGGTT
GATAAGAGAGTAGAGTCAAAGTACGGCCCACCCTGCCCACCTTGTCCAGCTCCCGAGTTCCTGGGCGGAC
CCTCAGTCTTTCTCTTCCCACCTAAACCCAAGGATACCCTTATGATCTCCAGGACTCCTGAGGTGACCTG
CGTTGTGGTCGACGTGTCACAAGAGGACCCTGAGGTACAGTTTAACTGGTACGTGGACGGTGTGGAGGTA
CATAACGCTAAGACTAAGCCACGAGAGGAGCAATTTAACTCCACTTACAGGGTGGTCAGCGTCCTGACCG
TTCTCCATCAGGACTGGCTGAACGGGAAGGAATATAAGTGTAAGGTTAGCAACAAAGGTCTGCCCAGTTC
TATCGAGAAGACAATCAGCAAGGCAAAAGGGCAGCCTCGGGAACCTCAGGTCTACACCCTCCCTCCTAGC
```

-continued

CAGGAAGAGATGACAAAGAACCAGGTCTCTCTCACCTGCCTGGTGAAAGGCTTCTATCCATCTGACATTG
CTGTGGAGTGGGAATCCAACGGCCAGCCTGAAAATAATTATAAGACCACACCCCCGTCCTTGATTCCGA
TGGATCTTTCTTCCTGTACAGTCGCCTCACCGTCGACAAATCACGGTGGCAGGAAGGTAACGTGTTCAGC
TGTTCTGTCATGCATGAGGCTCTGCATAACCATTACACACAAAAGTCTTTGTCATTGTCTCTCGGATGAT
GAGAATTCATTGATCATAATCAGCCATACCAC

SEQ ID NO: 432

EVQLLESGGGLVQPGGSLRLSCAASGFTFSSYAMSWVRQAPGKGLEWVSSIWRNGIVTVYADSVKGRFTI
SRDNSKNTLYLQMNSLRAEDTAVYYCAKWSAAFDYWGQGTLVTVSSASTKGPSVFPLAPCSRSTSESTAA
LGCLVKDYFPEPVTVSWNSGALTSGVHTFPAVLQSSGLYSLSSVVTVPSSSLGTKTYTCNVDHKPSNTKV
DKRVESKYGPPCP CPAPEFLGGPSVFLFPPKPKDTLMISRTPEVTCVVVDVSQEDPEVQFNWYVDGVEV
HNAKTKPREEQFNSTYRVVSVLTVLHQDWLNGKEYKCKVSNKGLPSSIEKTISKAKGQPREPQVYTLPPS
QEEMTKNQVSLTCLVKGFYPSDIAVEWESNGQPENNYKTTPPVLDSDGSFFLYSRLTVDKSRWQEGNVFS
CSVMHEALHNHYTQKSLSLSLG

SEQ ID NO: 433

GAAGTGCAGCTGCTCGAAAGCGGCGGAGGCTTGGTGCAGCCAGGAGGGAGCCTGCGACTGTCTTGCGCAG
CCAGCGGATTCACTTTCTCTTCCTATGCCATGAGCTGGGTTCGACAGGCACCCGGCAAAGGTCTCGAGTG
GGTGTCTAGCATCTGGCGAAACGGAATAGTTACAGTGTATGCCGATAGCGTGAAGGGTCGCTTTACTATT
TCACGGGATAATTCTAAGAACACCCTCTACCTGCAAATGAATAGCCTTAGGGCAGAAGATACCGCCGTGT
ACTACTGTGCCAAATGGTCCGCAGCCTTTGACTACTGGGGCCAGGGGACACTGGTGACCGTGTCCTCTGC
ATCAACCAAGGGGCCATCAGTGTTCCCACTCGCCCCATCTTCCAAGAGTACTTCCGGCGGAACCGCAGCC
CTTGGCTGCCTTGTTAAGGACTATTTCCCAGAACCCGTGACCGTAAGTTGGAACTCTGGCGCCCTTACTT
CTGGGGTGCACACCTTCCCAGCAGTGTTGCAGTCCAGTGGCCTTTACTCTCTGTCTAGTGTAGTGACTGT
GCCTTCCTCTAGTCTCGGTACCCAGACCTATATTTGTAATGTTAACCATAAGCCCAGCAATACAAAGGTT
GATAAGAAAGTGGAACCCAAGAGCTGCGATAAGACACATACCTGCCCACCTTGTCCAGCTCCCGAGCTGC
TGGGCGGACCCTCAGTCTTTCTCTTCCCACCTAAACCCAAGGATACCCTTATGATCTCCAGGACTCCTGA
GGTGACCTGCGTTGTGGTCGACGTGTCACATGAGGACCCTGAGGTAAAGTTTAACTGGTACGTGGACGGT
GTGGAGGTACATAACGCTAAGACTAAGCCACGAGAGGAGCAATACGCTTCCACTTACAGGGTGGTCAGCG
TCCTGACCGTTCTCCATCAGGACTGGCTGAACGGGAAGGAATATAAGTGTAAGGTTAGCAACAAAGCTCT
CCCTGCACCAATCGAGAAGACAATCAGCAAGGCAAAAGGGCAGCCTCGGGAACCTCAGGTCTACACCCTC
CCTCCTAGCAGGGAAGAGATGACAAAGAACCAGGTCTCTCTCACCTGCCTGGTGAAAGGCTTCTATCCAT
CTGACATTGCTGTGGAGTGGGAATCCAACGGCCAGCCTGAAAATAATTATAAGACCACACCCCCGTCCT
TGATTCCGATGGATCTTTCTTCCTGTACAGTAAACTCACCGTCGACAAATCACGGTGGCAGCAAGGTAAC
GTGTTCAGCTGTTCTGTCATGCATGAGGCTCTGCATAACCATTACACACAAAAGTCTTTGTCATTGTCTC
CAGGATGATGAGAATTCATTGATCATAATCAGCCATACCAC

SEQ ID NO: 434

EVQLLESGGGLVQPGGSLRLSCAASGFTFSSYAMSWVRQAPGKGLEWVSSIWRNGIVTVYADSVKGRFTI
SRDNSKNTLYLQMNSLRAEDTAVYYCAKWSAAFDYWGQGTLVTVSSASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKV
DKKVEPKSCDKTHTCPPCPAPELLGGPSVFLFPPKPKDTLMISRTPEVTCVVVDVSHEDPEVKFNWYVDG
VEVHNAKTKPREEQY A STYRVVSVLTVLHQDWLNGKEYKCKVSNKALPAPIEKTISKAKGQPREPQVYTL
PPSREEMTKNQVSLTCLVKGFYPSDIAVEWESNGQPENNYKTTPPVLDSDGSFFLYSKLTVDKSRWQQGN
VFSCSVMHEALHNHYTQKSLSLSPG

-continued

SEQ ID NO: 1202

```
EVQLLESGGGLVQPGGSLRLSCAASGFTFSSYAMSWVRQAPGKGLEWVSSIWRNGIVTVYADSVKGRFTI

SRDNSKNTLYLQMNSLRAEDTAVYYCAKWSAAFDYWGQGTLVTVSSASTKGPSVFPLAPSSKSTSGGTAA

LGCLVKDYFPEPVTVSWNSGALTSGVHTFPAVLQSSGLYSLSSVVTVPSSSLGTQTYICNVNHKPSNTKV

DKKVEPKSCDKTHTCPPCPAPELLGGPSVFLFPPKPKDTLMISRTPEVTCVVVDVSHEDPEVKFNWYVDG

VEVHNAKTKPREEQY☐STYRVVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSDGSFFLYSKLTVDKSRWQQGN

VFSCSVMHEALHNHYTQKSLSLSPG
```

Additional examples of heavy chain constant domains include, but are not limited to, a heavy chain constant region having a mutation or deletion at one or more of the following amino acids: Ser 228, Leu234, Leu235, Gly236, Gly237, Asp265, Asp270, Asn297, Lys 320, Lys 322, Glu328, Pro329, Pro331 as numbered in the EU index as set forth in Kabat, such that the Fc domain has less affinity for a Fc-gamma receptor.

Example 12. Evaluation of Efficiency of Masking Moieties

This assay measures the ability of the masking peptide to block binding of the activatable antibody to antigen as compared to the binding of the unmodified antibody to antigen.

The general outline for this assay is as follows: Nunc, Maxisorp plates are coated overnight at 4° C. with 100 μl/well of a 1 μg/mL solution of human PDL1 (R & D Systems) in PBS, pH 7.4. Plates are washed 3 times with PBST (PBS, pH 7.4, 0.05% Tween-20), and wells are blocked with 200 ml/well of 10 mg/mL BSA in PBST for 2 hours at RT. Plates are washed 3 times with PBST (PBS, pH 7.4, 0.05% Tween-20). Dilution curves are prepared, in 10 mg/mL BSA in PBST, as shown below in Table 10.

TABLE 10

Plate layout for masking efficiency assay, one plate for each time point.

| | [Antibody] = nM Columns 1-3 | [activatable antibody 1] = nM Columns 4-6 | [activatable antibody 2] = nM Columns 7-9 | [activatable antibody 3] = nM Columns 10-12 |
|---|---|---|---|---|
| A | 37 | 1000 | 1000 | 1000 |
| B | 12.3 | 333 | 333 | 333 |
| C | 4.1 | 111 | 111 | 111 |
| D | 1.34 | 37 | 37 | 37 |
| E | 0.45 | 12.3 | 12.3 | 12.3 |
| F | 0.15 | 4.1 | 4.1 | 4.1 |
| G | 0.03 | 1.34 | 1.34 | 1.34 |
| H | 0.01 | 0.45 | 0.45 | Blank |

Figure 17:
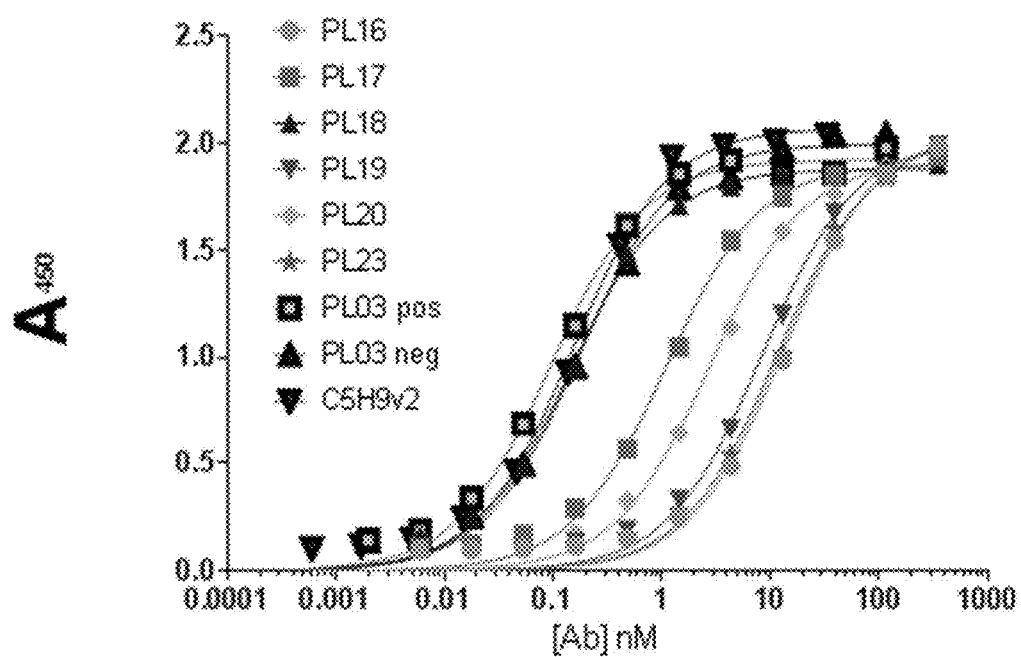
FIG. 17 is a graph depicting binding isotherms for anti-PDL1 activatable antibodies that include the anti-PDL1 antibody C5H9v2.

The binding solutions are added to the plates, which are then are incubated for 1 hour at room temperature (RT), and then washed 3 times with PBST (PBS, pH 7.4, 0.05% Tween-20). One hundred (100) μl/well 1:4000 dilution goat-anti-human IgG (Fab specific, Sigma cat # A0293) in 10 mg/mL BSA in PBST is added, and the plate is incubated for 1 hour at RT. The plate is developed with TMB and 1N HCl. Shown in FIGS. 15A, 15B, 16A, and 17A are plots of binding isotherms for anti-PDL1 activatable antibodies that include the anti-PDL1 antibody C5H9v2 described herein. Plots are generated in Prizm (Sigma Plot) and the data are fit to a model of single site saturation and a Kd is determined. In FIG. 17A, PL03+ is an effector positive activatable antibody, namely wild type IgG1. PL03− is an effector negative activatable antibody, namely mutated IgG1 N297Q.

Masking efficiency is calculated by dividing the Kd for binding of the activatable antibodies by the Kd of the parental antibody. Masking efficiencies are shown in FIGS. 15A, 15B, 16A, AND 17A.

Example 13. Anti-PDL1 Activatable Antibodies of the Disclosure Delay Induction of Diabetes in NOD Mice In this Example, anti-PDL1 activatable antibodies PL15-0003-05H9v2 and PL18-0003-05H9v2 were analyzed for the ability to induce diabetes in NOD mice. The NOD mice, substrain NOD/ShiLtJ, were obtained from Jackson Laboratory at 6 weeks and acclimated on site. At 9.5 weeks, mice were checked for diabetes prior to enrollment, grouped, and dosed as set forth in Table 19.

TABLE 19

Groups and doses for diabetes study with anti-PDL1 activatable antibodies

| Group | Count | Treatment | Dose (mg/kg) | Dose volume (mL/kg) | Schedule | Route |
|---|---|---|---|---|---|---|
| 1 | 8 | mIgG2a (C1.18.4) | 3 | 10 | Day 0 | IP |
| 2 | 8 | Anti-PDL1 (C5H9v2) | 1 | 10 | Day 0 | IP |
| 3 | 8 | Anti-PDL1 (C5H9v2) | 0.3 | 10 | Day 0 | IP |
| 4 | 8 | Activatable Antibody PL15-0003-C5H9v2 | 1 | 10 | Day 0 | IP |
| 5 | 8 | Activatable Antibody PL18-0003-C5H9v2 | 1 | 10 | Day 0 | IP |

Figure 18A:
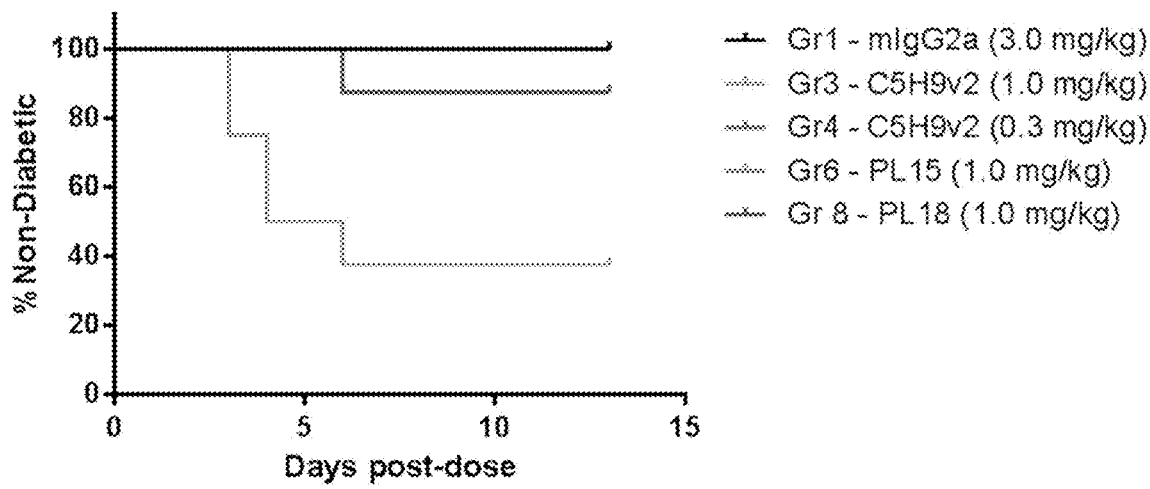
FIGS. 18A and 18B are a series of graphs depicting that anti-PDL1 activatable antibody PL15-0003-05H9v2, when administered at a dose of 1 mg/kg, has an absence of diabetes induction and anti-PDL1 activatable antibody PL18-0003-05H9v2, when administered at a dose of 1 mg/kg, has a delay in diabetes induction compared to the anti-PDL1 antibody C5H9v2 administered at a dose of 1 mg/kg in NOD mice (FIG. 18A); in addition, anti-PDL1 activatable antibody PL15-0003-05H9v2, when administered at a dose of 3 mg/kg induced diabetes in 2 of 8 NOD mice (75% non-diabetic), compared to 1 mg/kg anti-PDL1 antibody C5H9v2 which led to 38% non-diabetic NOD mice (FIG. 18B).

FIG. 18A, which plots % non-diabetic versus number of days post initial dose, shows that anti-PDL1 antibody C5H9v2 induced diabetes in NOD mice at 1 mg/kg while the anti-PDL1 activatable antibody PL15-0003-05H9v2 (labeled herein as Gr4-PF15) did not induce diabetes and the anti-PDL1 activatable antibody PL18-0003-05H9v2 exhibited delayed diabetes at 1 mg/kg. Control mIgG2a and anti-PDL1 antibody C5H9v2 at 0.3 mg/kg did not induce diabetes in NOD mice. In an additional group, a single 3 mg/kg dose of anti-PDL1 activatable antibody PL15-0003-

Figure 18B:
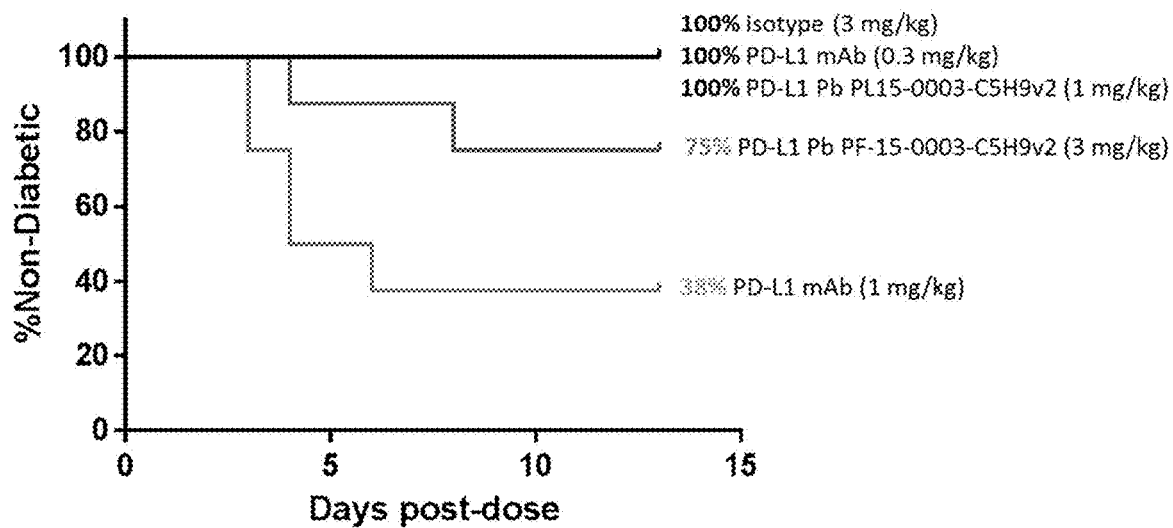

05H9v2 administered IP at a dose volume of 10 mL/kg induced diabetes in 2 of 8 mice (75% non-diabetic), providing a greater than three-fold safety margin relative to anti-PDL1 antibody C5H9v2 (Group 2). Results are shown in FIG. 18B.

Example 14. Anti-PDL1 Activatable Antibodies of the Disclosure Reduce MC38 Tumors in Mice In this Example, anti-PDL1 activatable antibodies PL15-0003-05H9v2 and PL18-0003-05H9v2 were analyzed for the ability to reduce the growth of MC38 syngeneic tumors.

The mouse colon carcinoma cell line MC38 was obtained from ATCC. MC38 were grown in RPMI-1640 supplemented with 10% fetal bovine serum at 37° C. in an atmosphere of 5% $CO_2$ in air. Cells were harvested during the logarithmic growth period, resuspended in PBS with proper cell concentration, and kept on ice for tumor induction.

Each mouse was inoculated subcutaneously in the right flank with $0.5 \times 10^6$ of MC38 cells in PBS for tumor development. The treatments were started when the mean tumor size reached approximately 100-200 $mm^3$ (no more than 200 $mm^3$). Tumor sizes were measured twice weekly in two dimensions using a caliper, and the volume was expressed in $mm^3$ using the formula: $V=0.5\ a \times b^2$ where a and b are the long and short diameters of the tumor, respectively.

The mice were grouped and dosed as set forth in Table 20.

TABLE 20

Groups and doses for MC38 syngeneic study with anti-PDL1 activatable antibodies

| Group | Count | Treatment | Dose (mg/kg) | Dose volume (mL/kg) | Schedule | Route |
|---|---|---|---|---|---|---|
| 1 | 9 | mIgG2a (C1.18.4) | 10 | 10 | t.i.w. for 2 weeks | IP |
| 2 | 9 | Anti-PDL1(C5H9v2) | 10 | 10 | t.i.w. for 2 weeks | IP |
| 4 | 9 | PL18-0003-C5H9v2 | 10 | 10 | t.i.w. for 2 weeks | IP |
| 6 | 9 | PL15-0003-C5H9v2 | 10 | 10 | t.i.w. for 2 weeks | IP |

Figure 19:
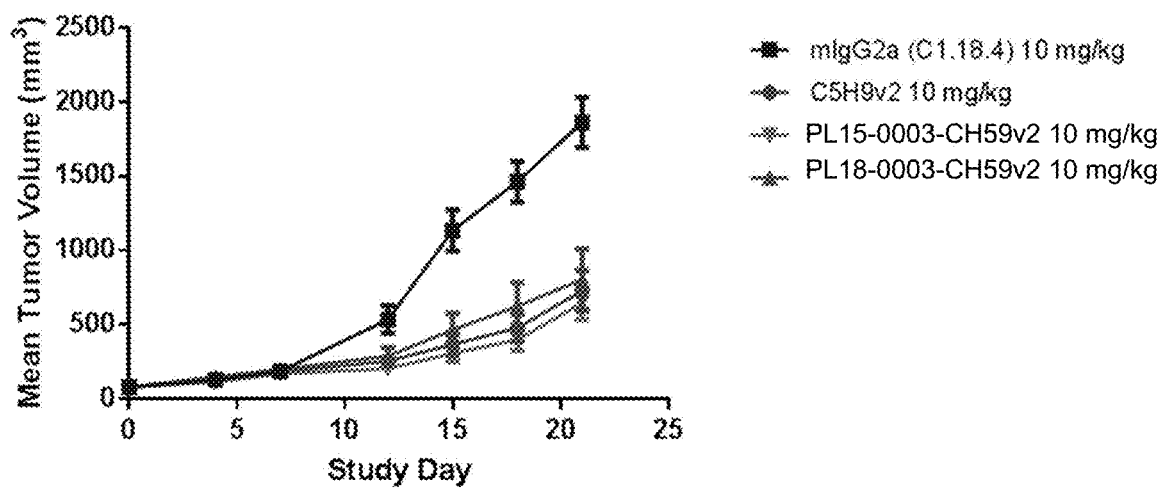
FIG. 19 is a graph depicting that anti-PDL1 activatable antibodies PL15-0003-C5H9v2 and PL18-0003-05H9v2 inhibit the growth of MC38 syngeneic tumors similar to anti-PDL1 antibody C5H9v2.

FIG. 19A, which plots tumor volume versus number of days post initial dose, demonstrates that anti-PDL1 activatable antibodies PL15-0003-05H9v2 and PL18-0003-C5H9v2 inhibited the growth of MC38 syngeneic tumors similar to positive control anti-PDL1 antibody C5H9v2.

Example 15. An Anti-PDL1 Activatable Antibody of the Disclosure Demonstrates Reduced PDL1 Occupancy in Blood and Spleen from C57B1/6 Mice Unlike an antibody that would bind target antigen indiscriminately, an activatable antibody would be a molecule that is inert unless it is activated in the tumor microenvironment. Once activated, the cleaved activatable antibody would bind the targeted antigen within the tumor only, sparing the antigens in the peripheral areas. PDL1 is expressed in tumor cells as well as T cells (CD4+ and CD8+) in circulation and the spleen. This example demonstrates that animals treated with anti-PDL1 activatable antibody did not have detectable activatable antibody on T cells in the periphery, while animals treated with anti-PDL1 antibody showed a detectable dose dependent presence of antibody on T cells in the periphery.

To measure whether anti-PDL1 activatable antibody PL15-0003-05H9v2 is protected from binding T cells in circulation and the spleen compared to the anti-PDL1 antibody C5H9v2, 14-week old C57B1/6 mice (with tumors ranging from 38-671 mm3) were dosed as set forth in Table 21. Tumor sizes were measured in two dimensions using a caliper, and the volume was expressed in $mm^3$ using the formula: $V=0.5\ a \times b^2$ where a and b are the long and short diameters of the tumor, respectively. After about 20 hours, animals were euthanized; and blood, spleen, and plasma were harvested from each animal.

TABLE 21

Groups and doses for PDL1 occupancy study

| Group | Count | Treatment | Dose (mg/kg) | Dose volume (mL/kg) | Schedule | Route |
|---|---|---|---|---|---|---|
| 1 | 2 | mIgG2a (C1.18.4) | 1 | 10 | Day 0 | IP |
| 2 | 2 | Anti-PDL1(C5H9v2) | 1 | 10 | Day 0 | IP |
| 3 | 2 | Anti-PDL1(C5H9v2) | 0.3 | 10 | Day 0 | IP |
| 4 | 2 | Anti-PDL1(C5H9v2) | 0.1 | 10 | Day 0 | IP |
| 5 | 2 | PL15-0003--C5H9v2 | 1 | 10 | Day 0 | IP |
| 6 | 2 | PL15-0003-C5H9v2 | 0.3 | 10 | Day 0 | IP |

Figure 20A:
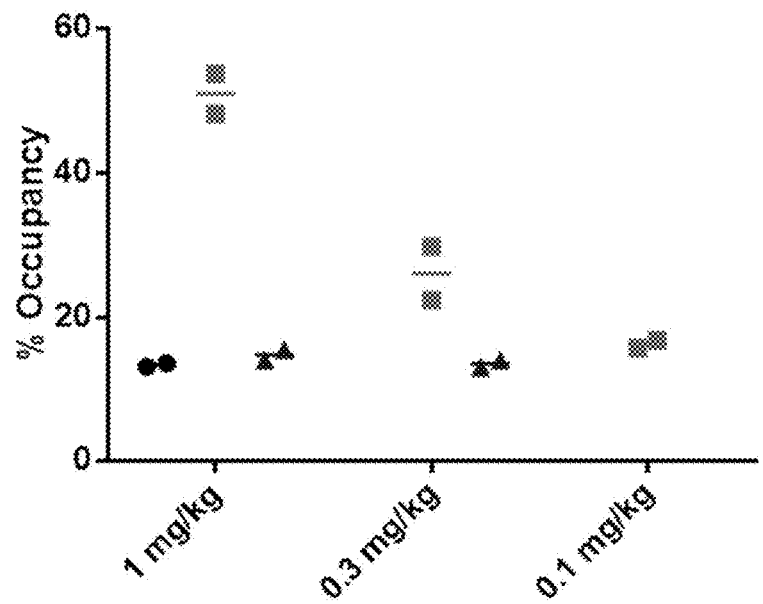
FIGS. 20A, 20B, 20C, and 20D are a series of graphs depicting the percent of anti-PDL1 antibody C5H9v2 and anti-PDL1 activatable antibody PL15-0003-05H9v2 bound to CD4+ and CD8+ T cells from peripheral blood (FIGS. 20A, 20B) or spleen (FIGS. 20C, 20D). In all graphs, the circle represents isotype, the square represents anti-PDL1 antibody C5H9v2, and the triangle represents anti-PDL1 activatable antibody PL15-0003-05H9v2.
Figure 20B:
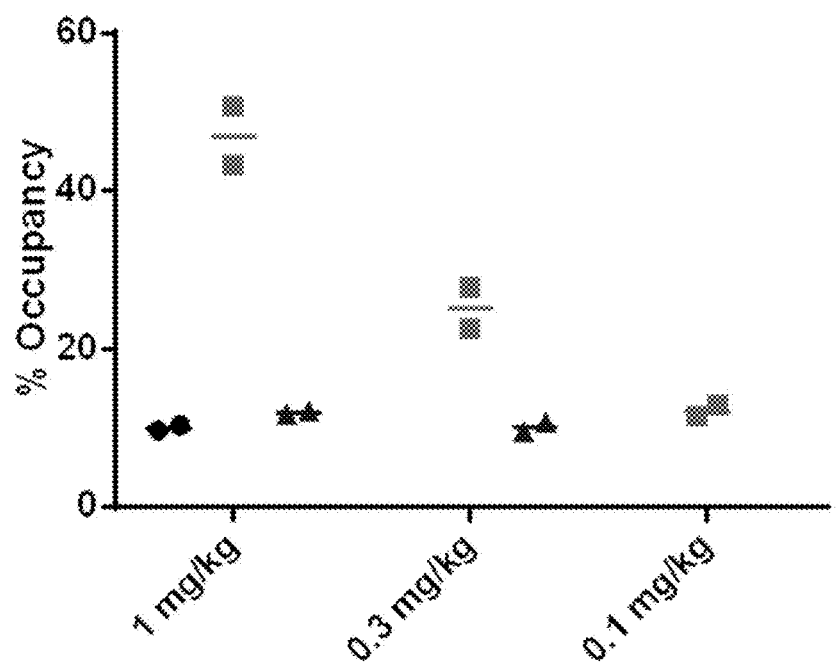
Figure 20C:
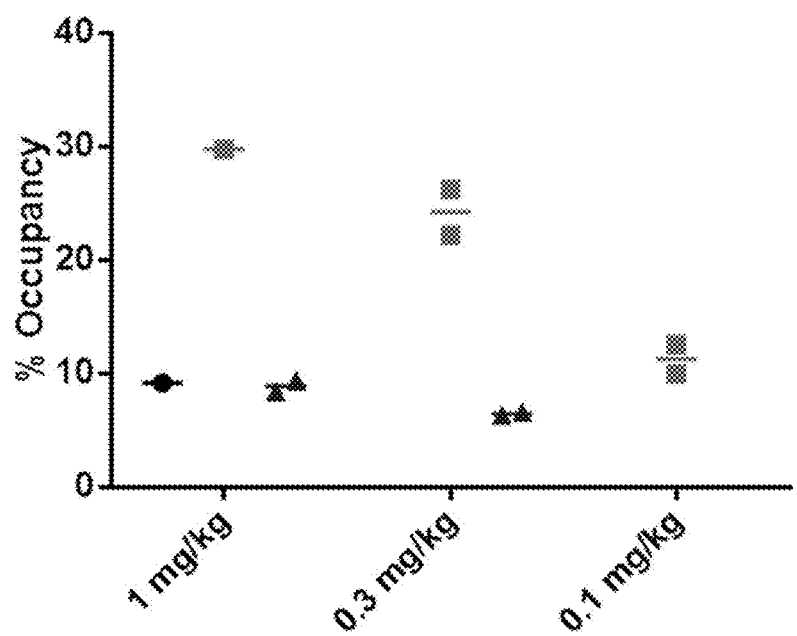
Figure 20D:
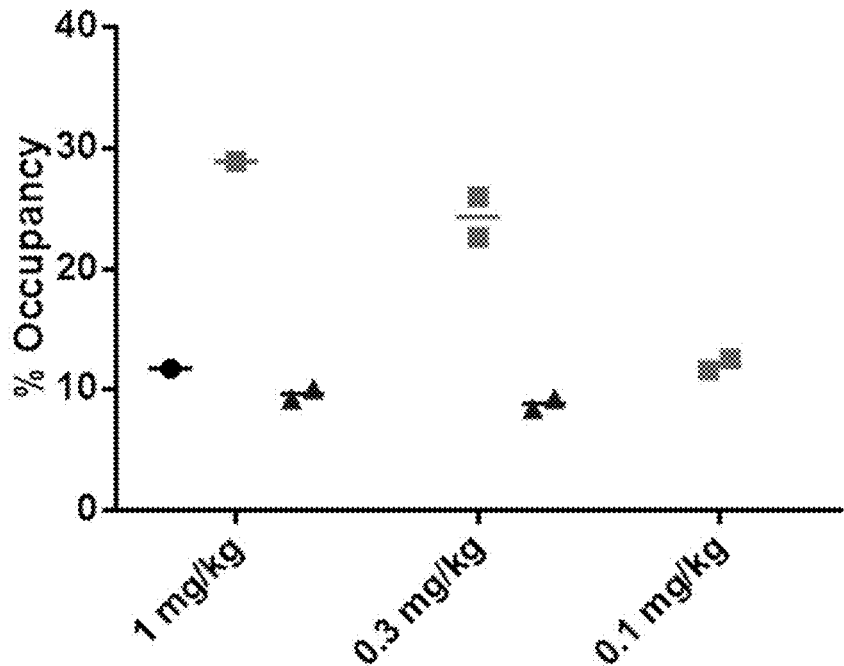

Whole blood was processed as follows: One volume of blood was added to 10 volumes of RBC Lysis Solution (130-094-183 Miltenyi Biotec) and processed using manufacturer's protocol. Lymphocytes were resuspended in staining buffer (HBSS 2% FBS). Spleen was processed as follows: Spleen was placed in a 70 uM cell strainer (352350 Corning/BD Falcon) with 1 mL of serum free RPMI-1640. The back of a 3-mL syringe was used to mash the spleen in a circular motion. The strainer was washed with media. Splenocytes were pelleted using a centrifuge and blood was lysed using 10 volumes of RBC Lysis Solution (130-094-183 Miltenyi Biotec) according to manufacturer's protocol. Splenocytes were refiltered after resuspending in staining buffer (HBSS 2% FBS). Lymphocytes from whole blood and lymphocytes from spleen were counted and were aliquoted to wells of a 96-well round bottom plates (5e5 cells/well). Cells were pelleted and mouse FcR Reagent was added 1:10 dilution according to manufacturer's protocol (130-092-575 Miltenyi Biotec). One set of cells was stained with a saturating amount, 100 nM, of anti-PDL1 antibody C5H9v2 for 60 minutes to obtain a maximum saturation value. Cells were washed 3 times and are stained with a biotinylated 'a' allotype antibody, anti-mIgG2a(a) clone 8.3 (553502 BD Biosciences) at 300 ng/mL for 60 minutes. Cells were washed 3 times and then stained with 1 ug/mL (also referred to herein as "µg/mL") of anti-CD4-Pacific Blue (558107 BD Bioscience), 1 ug/mL of anti-CD8-APC (553035 BD Bioscience) and 1:500 dilution of SAPE (S-866 Life Technologies) for 30 minutes. Cells were washed 2 times and stained with 7-AAD according to manufacturer's protocol (559925 BD Bioscience). The MACSQuant flow cytometer was used to measure the amount of anti-PDL1 antibody C5H9v2 and anti-PDL1 activatable antibody PL15-0003-05H9v2 bound to T cells from whole blood and the spleen. Briefly, at the most 30,000 events were collected in the lymphocyte gate. Live cells were gated from the 7AAD negative gate. CD4+ and CD8+ cells were gated separately and anti-PDL1 mAb and anti-PDL1 activatable antibody MFI were recorded for both CD4 and CD8. Percent occupancy was determined by taking the MFI of the sample compared to the average of the MFI for the maximum binding MFI. FIGS. 20A-20D demonstrate the percent of anti-PDL1 antibody C5H9v2 and anti-PDL1 activatable antibody PL15-0003-05H9v2 bound to CD4+ and CD8+ T cells from peripheral blood (FIGS. 20A, 20B) or spleen (FIGS. 20C, 20D). In all graphs, the circle represents isotype, the square represents anti-PDL1 antibody C5H9v2, and the triangle represents anti-PDL1 activatable antibody PL15-0003-C5H9v2. Percent occupancy of the anti-PDL1 antibody C5H9v2 was reflective of the dose titration. Percent occupancy of the anti-PDL1 activatable antibody PL15-0003-05H9v2 at 1 mg/kg was similar to isotype control mIgG2a at 1 mg/kg.

Example 16. An Anti-PDL1 Activatable Antibody of the Disclosure Demonstrates Reduced PDL1 Occupancy in Blood and Spleen from C57B1/6 Mice This example demonstrates that animals treated with an anti-PDL1 activatable antibody of the disclosure exhibited reduced binding to blood T cells from tumor bearing mice compared to that exhibited by an anti-PDL1 antibody of the disclosure at a variety of doses.

Figure 21A:
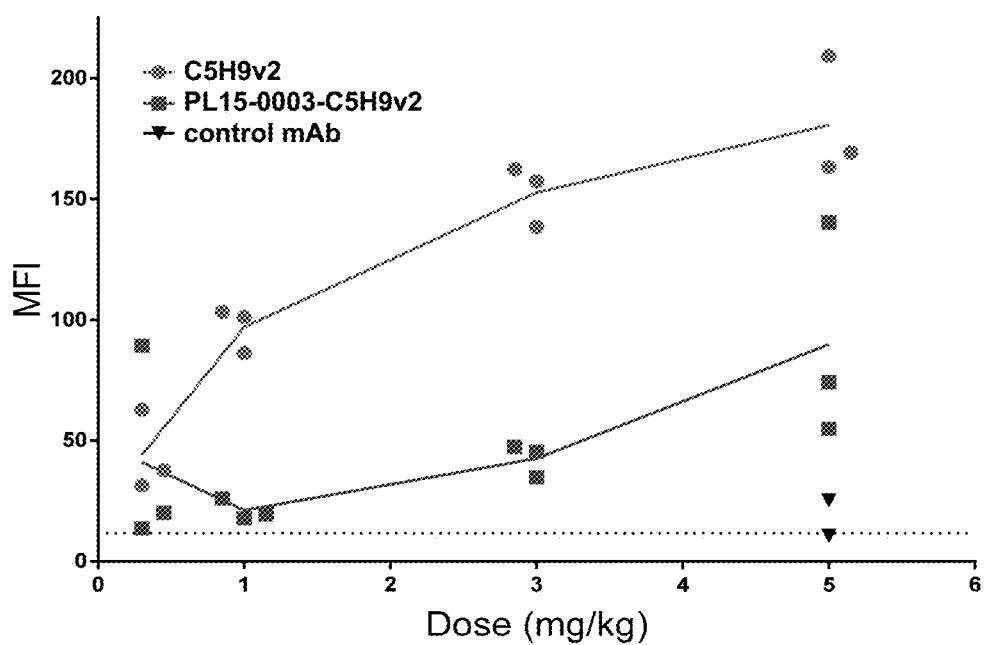
FIGS. 21A and 21B are a series of graphs depicting that the presence of tumor-derived proteases capable of cleaving anti-PDL1 activatable antibody PL15-0003-05H9v2 (depicted by squares) did not lead to high levels of activated activatable antibody in the blood compared to anti-PDL1 antibody C5H9v2 (depicted by circles) or an isotype antibody (depicted by triangles) (FIG. 21A) despite the plasma concentrations of the activatable antibody being higher than those of the antibody (FIG. 21B).
Figure 21B:
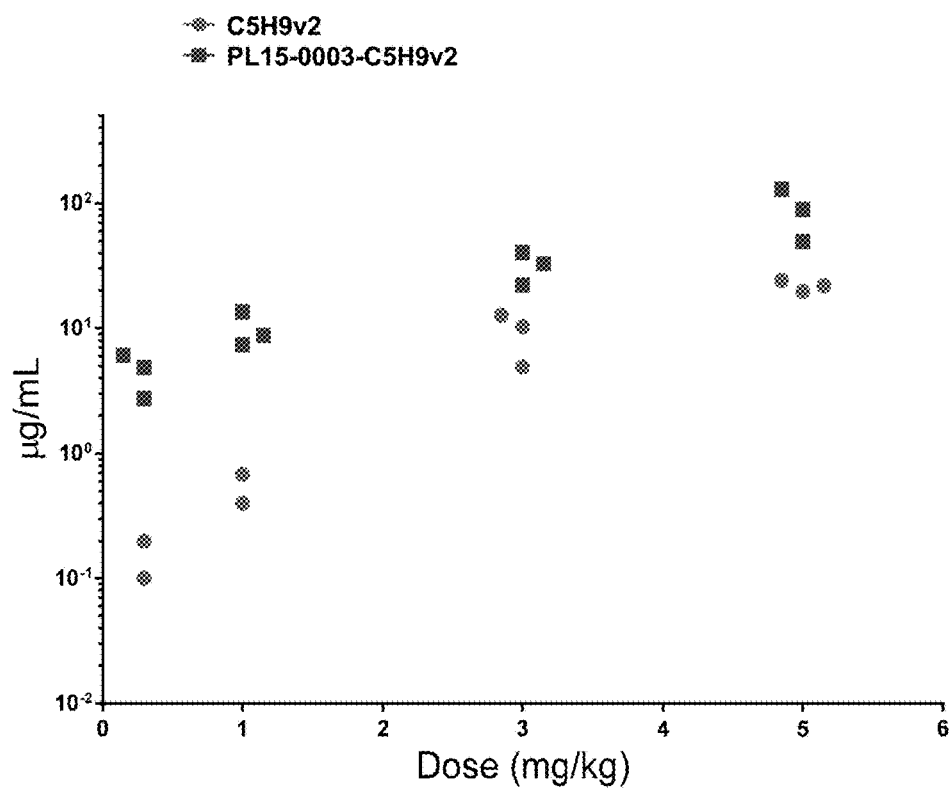

The study was conducted in a manner similar to that described in Example 15. Briefly, mice bearing MC38 tumors between 100-200 mm$^3$ were treated with a single dose of anti-PDL1 antibody C5H9v2 or anti-PDL1 activatable antibody PL15-0003-05H9v2 as indicated in FIGS. 21A and 21B, and blood was analyzed for surface bound antibody by flow cytometry four days after dosing. Plasma concentrations of the antibody and activatable antibody were determined by ELISA. FIGS. 21A and 21 B demonstrate that the presence of tumor-derived proteases capable of cleaving the activatable antibody did not lead to high levels of activated activatable antibody in the blood (FIG. 21A); i.e., the activatable antibody (depicted by squares) demonstrated reduced peripheral PDL1 binding in tumor-bearing mice compared to the antibody (depicted by circles) or an isotype antibody (depicted by triangles) despite the plasma concentrations of the activatable antibody being higher than those of the antibody (FIG. 21B).

Example 17. Activity of an Anti-PDL1 Antibody and an Anti-PDL1 Activatable Antibody of the Embodiments in a Human T-Cell Restimulation Assay In this example, peripheral blood mononuclear cells from a CMV-positive donor were incubated in the presence of CMV viral lysate and an anti-PDL1 antibody or an anti-PDL1 activatable antibody of the disclosure to assess the effect of such anti-PDL1 antibody or anti-PDL1 activatable antibody on interferon gamma (IFN-gamma) cytokine secretion.

Figure 22:
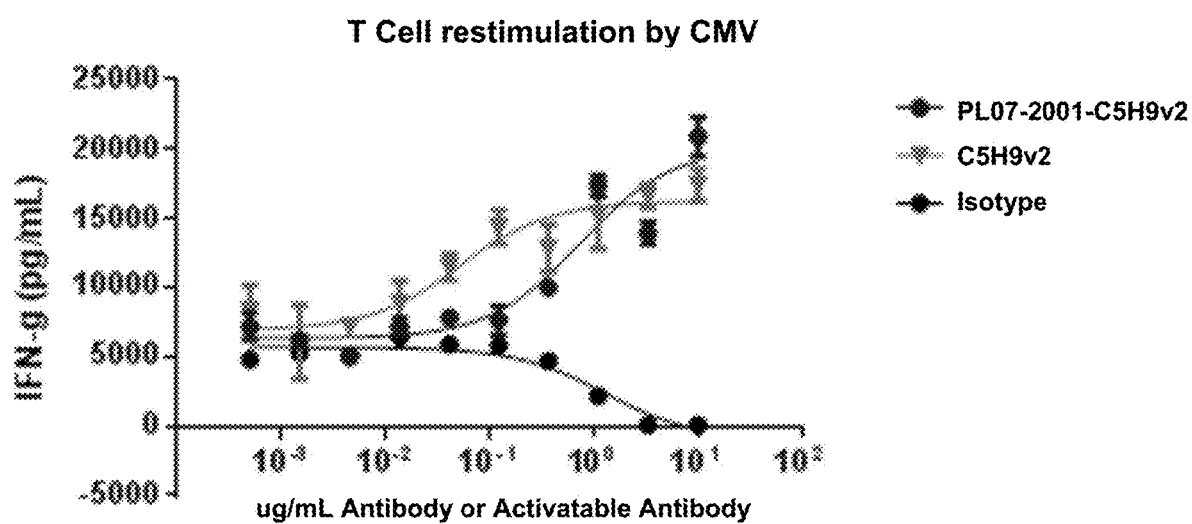
FIG. 22 is a graph depicting the ability of anti-PDL1 activatable antibody PL07-2001-05H9v2 to increase CMV-stimulated IFN-gamma secretion as compared to control hIgG4, but with decreased potency relative to anti-PDL1 parental antibody C5H9v2.
Figure 23A:
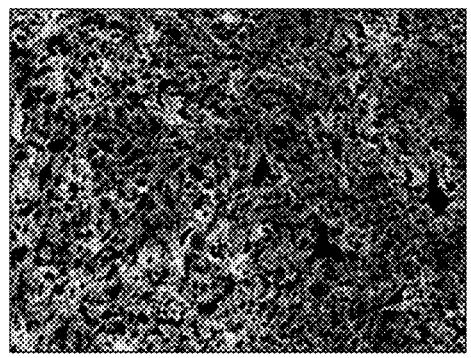
FIGS. 23A, 23B, 23C, and 23D are a series of images showing the ability of anti-PDL1 activatable antibody PL15-0003-05H9v2 to be activated and to bind frozen MC38 mouse cancer tissues using an in situ imaging method.
Figure 23B:
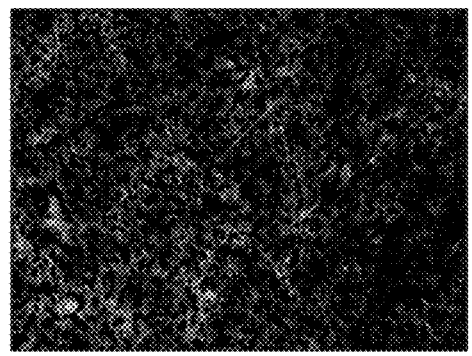
Figure 23C:
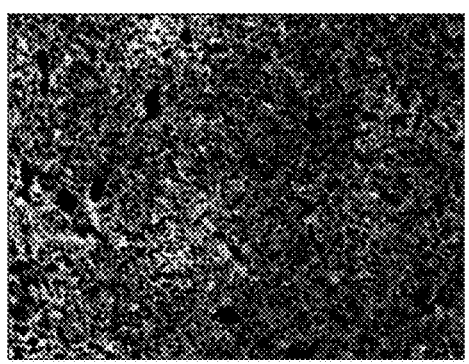
Figure 23D:

PBMCs from a CMV-positive donor (Hemacare Donor C) were plated at 3.5×10$^5$ cells per well in the presence of 4 µg/mL CMV viral lysate (Astarte) and either anti-PDL1 antibody C5H9v2, anti-PDL1 activatable antibody PL07-2001-05H9v2, or an hIgG4 isotype control antibody. After four days, supernatant was removed from each well and IFN-gamma levels were assayed using IFN-gamma ELISA kit (Life Technologies, Carlsbad, Calif.). FIG. 22A demonstrates that anti-PDL1 activatable antibody PL07-2001-05H9v2 exhibited increased CMV-stimulated IFN-gamma secretion compared with control hIgG4 but decreased potency relative to anti-PDL1 parental antibody C5H9v2 due to the activatable antibody being masked.

Example 18. In Situ Imaging of an Anti-PDL1 Activatable Antibody of the Disclosure This Example demonstrates the ability of anti-PDL1 activatable antibody PL15-0003-05H9v2 to be activated and to bind frozen MC38 mouse cancer tissues using an in situ imaging method.

Fluorescently-labeled anti-PDL1 activatable antibody PL15-0003-05H9v2 or anti-PDL1 antibody C5H9v2 was incubated on frozen PDL1+MC38 tumor sections for 1 hour in a protease-compatible buffer in the presence or absence of a broad spectrum inhibitor cocktail as described in PCT International publication number WO 2014/107599, published Jul. 10, 2014.

Results are shown in FIGS. 23A-23D. The tissue image in FIG. 23A demonstrates binding of anti-PDL1 antibody C5H9v2 to the tumor section indicating the presence of PDL1 antigen in the tumor section. The tissue image in FIG. 23B demonstrates that anti-PDL1 activatable antibody PL15-0003-05H9v2 was activated by tumor-derived proteolytic cleavage of the anti-PDL1 activatable antibody to yield an anti-PDL1 antibody that bound to the PDL1 target in the tumor section. The tissue image in FIG. 23D demonstrates that the fluorescent signal shown in FIG. 23B was inhibited by pre-treatment of the tumor section with a 1:100 dilution of broad spectrum inhibitor cocktail set III and 50 mM EDTA, whereas no effect of broad spectrum protease inhibitors was detected on the binding of anti-PDL1 antibody C5H9v2 to the tumor section as demonstrated in the tissue image in FIG. 23C. These results demonstrate that the tumor sections comprise sufficient protease activity to activate activatable antibodies of the disclosure.

Example 19. Ability of an Activatable Antibody of the Disclosure to Demonstrate Protease-Dependent Binding and Blocking Activity In Vitro This Example demonstrates the ability anti-PDL1 activatable antibody PL15-0003-05H9v2 to exhibit protease-dependent binding and blocking activity in vitro.

Binding and blocking studies were conducted on anti-PDL1 antibody C5H9v2 and anti-PDL1 activatable antibody PL15-0003-05H9v2 in a manner similar to those described elsewhere in the Examples except that plates were coated with 0.5 µg/mL PDL1.

Figure 24:
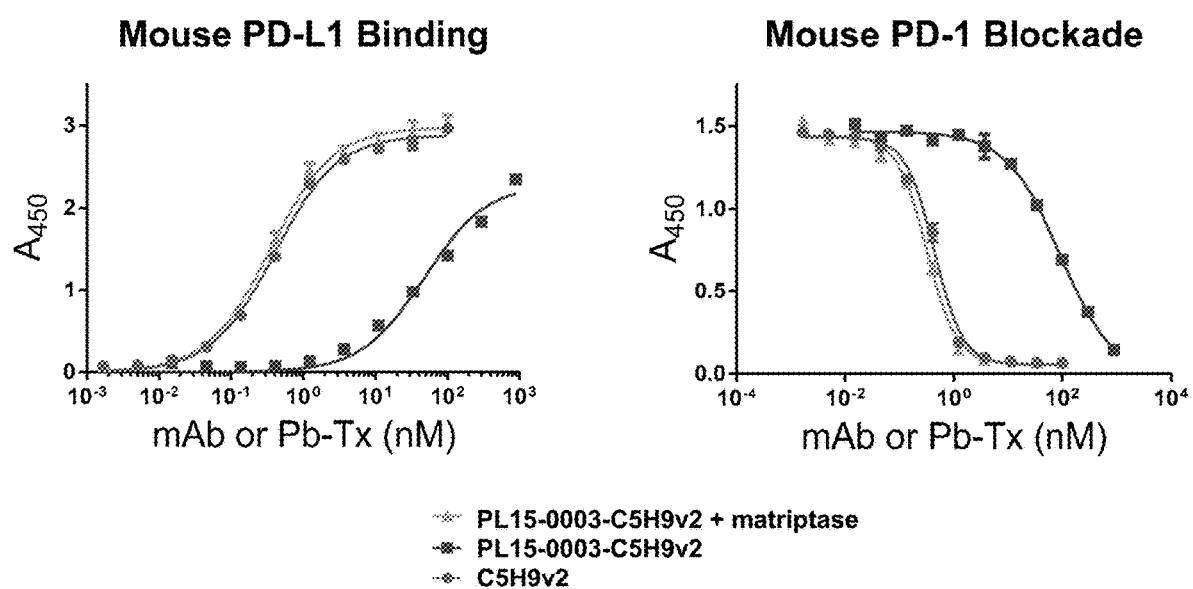
FIG. 24 depicts that anti-PDL1 activatable antibody PL15-0003-05H9v2 exhibited a higher $EC_{50}$ for PDL1 binding and PD1 blocking than did the anti-PDL1 antibody as measured by ELISA. The figure further demonstrates that activation of anti-PDL1 activatable antibody PL15-0003-05H9v2 by matriptase fully restored PDL1 binding and PD1 blocking activities to levels comparable to those of anti-PDL1 antibody C5H9v2.

FIG. 24A depicts that anti-PDL1 activatable antibody PL15-0003-05H9v2 exhibited a higher EC$_{50}$ for PDL1 binding and PD1 blocking than did the anti-PDL1 antibody as measured by ELISA. The figure further demonstrates that activation of anti-PDL1 activatable antibody PL15-0003-05H9v2 by matriptase fully restored PDL1 binding and PD1 blocking activities to levels comparable to those of anti-PDL1 antibody C5H9v2.

Example 20. Ability of an Anti-PDL1 Activatable Antibody of the Disclosure to Reduce Binding to PDL1 and to Demonstrate Protease-Dependent Blocking Activity In Vitro This Example measures the ability of a masking peptide to reduce binding of an anti-PDL1 activatable antibody of the disclosure to PDL1 compared to the ability of the parental antibody to bind to PDL1 in vitro. This Example also demonstrates the ability of an anti-PDL1 activatable antibody of the disclosure to exhibit protease-dependent blocking activity in vitro.

Figure 25A:
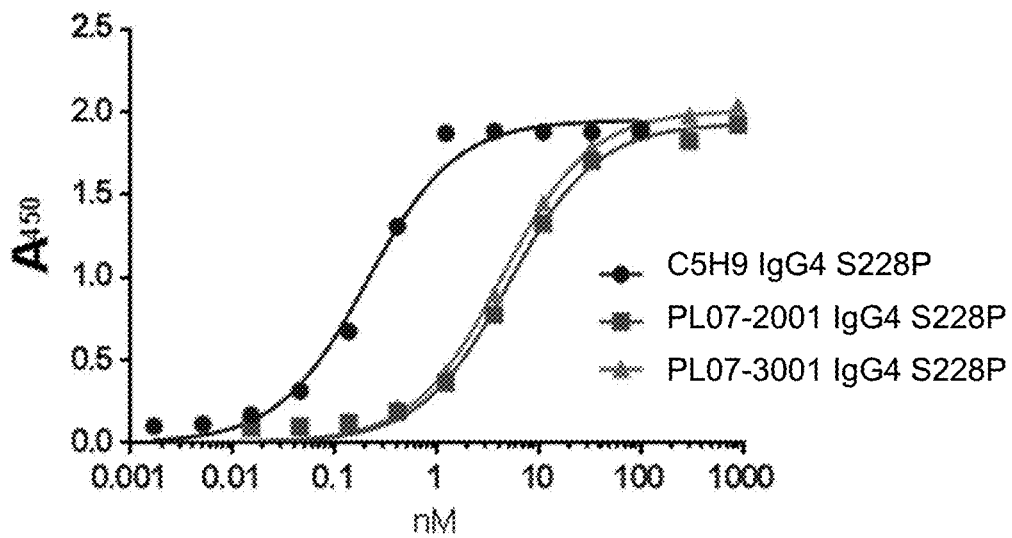
FIGS. 25A and 25B are a series of graphs depicting the ability of anti-PDL1 activatable antibodies referred to herein as PL07-2001-05H9v2 and PF07-3001-05H9v2 and of the anti-PDL1 antibody referred to herein as C5H9 to bind to human or murine PDL1.
Figure 25B:
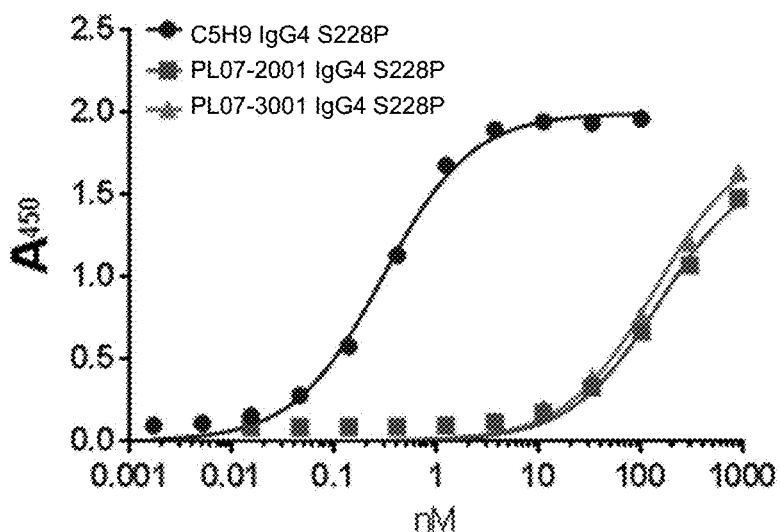

The abilities of anti-PDL1 activatable antibodies PL07-2001-05H9v2 and PF07-3001-05H9v2 and anti-PDL1 antibody C5H9 to bind to human or murine PDL1 were tested in a manner similar to techniques described elsewhere in the Examples. Results are shown in FIGS. 25A and B.

The abilities of anti-PDL1 activatable antibody PL07-2001-05H9v2, uPA-activated anti-PDL1 activatable antibody PL07-2001-05H9v2, MMP14-activated anti-PDL1 activatable antibody PL07-2001-05H9v2, and anti-PDL1 antibody C5H9v2 to block PD1 (PD-1) or B7-1 binding to PDL1 were tested in a manner similar to techniques described elsewhere in the Examples.

Figure 26A:
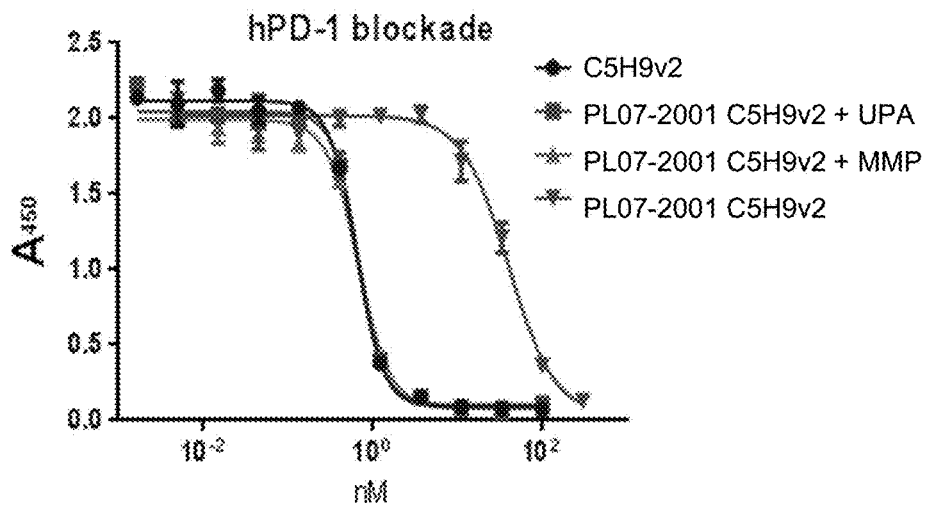
FIGS. 26A, 26B, and 26C are a series of graphs depicting the abilities of anti-PDL1 activatable antibody PL07-2001-05H9v2, uPA-activated anti-PDL1 activatable antibody PL07-2001-05H9v2, MMP14-activated anti-PDL1 activatable antibody PL07-2001-05H9v2, and anti-PDL1 antibody C5H9v2 to block human PD1 (PD-1) to human PDL1 (FIG. 26A), cynomolgus PD1 (PD-1) binding to cynomolgus PDL1 (FIG. 26B), or rat PD1 (PD-1) binding to rat PDL1 (FIG. 26C).
Figure 26B:
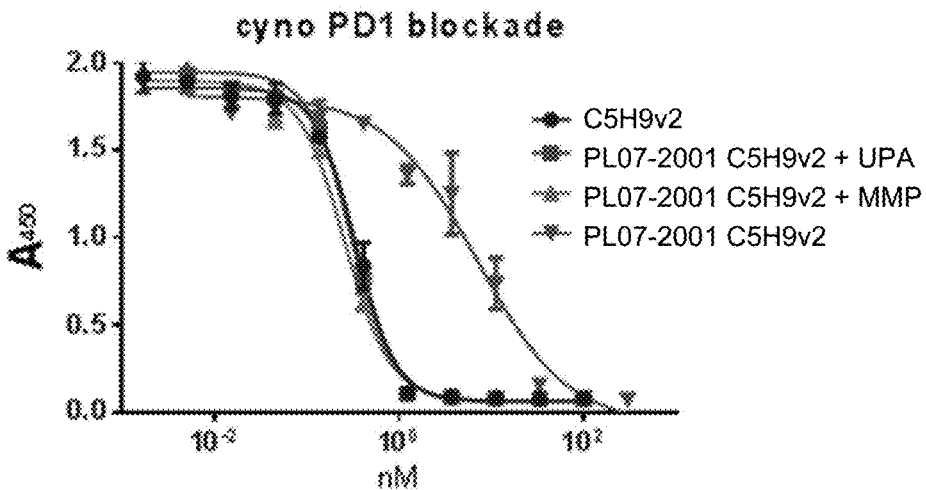
Figure 26C:
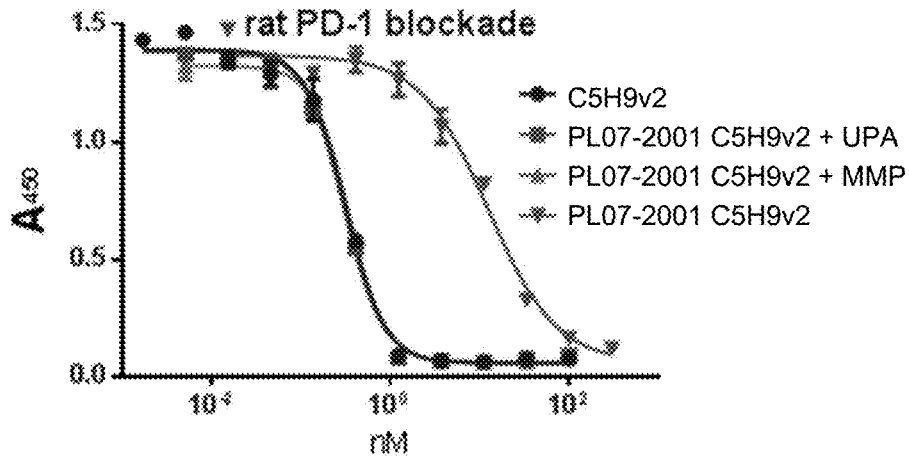

Briefly, for the PD1 blockade assay, human, cyno or rat PDL1 was adsorbed to the well of an ELISA plate. Biotinylated human, cyno, or rat PD1 was applied to the wells in the absence or presence of an increasing concentration of either anti-PDL1 activatable antibody PL07-2001-05H9v2, uPA-activated anti-PDL1 activatable antibody PL07-2001-05H9v2, MMP14-activated anti-PDL1 activatable antibody PL07-2001-05H9v2, or anti-PDL1 antibody C5H9v2. Results, shown in FIGS. 26A to C, indicate that activatable antibody PF07-2001-C5H9v2 exhibited a higher $EC_{50}$ for PD1 blocking than did the anti-PDL1 antibody as measured by ELISA. However, activation of the activatable antibody by either uPA or MMP14 restored PD1 blocking activity to levels comparable to those of anti-PDL1 antibody C5H9v2.

Figure 27A:
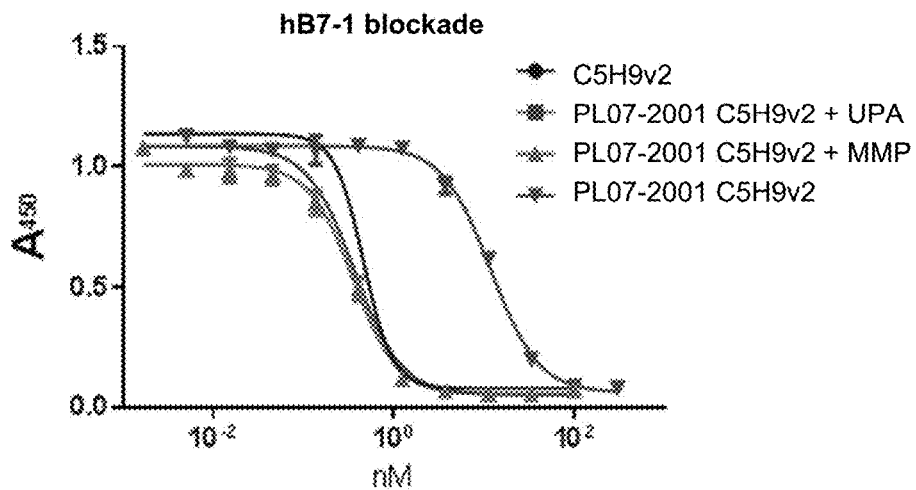
FIGS. 27A and 27B are a series of graphs depicting the ability of anti-PDL1 activatable antibody PL07-2001-05H9v2, uPA-activated anti-PDL1 activatable antibody PL07-2001-05H9v2, MMP14-activated anti-PDL1 activatable antibody PL07-2001-05H9v2, or anti-PDL1 antibody C5H9v2 to human B7-1 binding to human PDL1 (FIG. 27A) or cynomolgus B7-1 binding to cynomolgus PDL1 (FIG. 27B).
Figure 27B:
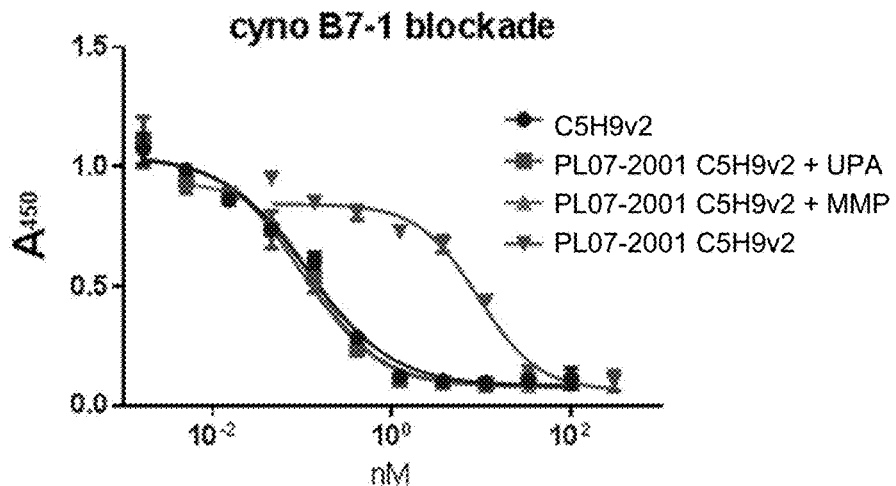

Briefly, for the B7-1 blockade assay, human or cyno PDL1 was adsorbed to the well of an ELISA plate. Biotinylated human or cyno B7-1 was applied to the wells in the absence or presence of an increasing concentration of either anti-PDL1 activatable antibody PL07-2001-C5H9v2, uPA-activated anti-PDL1 activatable antibody PL07-2001-05H9v2, MMP14-activated anti-PDL1 activatable antibody PL07-2001-05H9v2, or anti-PDL1 antibody C5H9v2. Results, shown in FIGS. 27A and B, indicate that activatable antibody PF07-2001-05H9v2 exhibited a higher $EC_{50}$ for B7-1 blocking than did the anti-PDL1 antibody as measured by ELISA. However, activation of the activatable antibody by either uPA or MMP14 restored B7-1 blocking activity to levels comparable to those of anti-PDL1 antibody C5H9v2.

Example 21. Anti-PDL1 Activatable Antibodies of the Disclosure Reduce MC38 Tumors in Mice In this Example, anti-PDL1 activatable antibodies PL15-0003-05H9v2, PL15-2001-05H9v2, and PL15-3001-05H9v2 were analyzed for the ability to reduce the growth of MC38 syngeneic tumors.

The mouse colon carcinoma cell line MC38 was obtained from ATCC. MC38 were grown in RPMI-1640 supplemented with 10% fetal bovine serum at 37° C. in an atmosphere of 5% $CO_2$ in air. Cells were harvested during the logarithmic growth period, resuspended in PBS with proper cell concentration, and kept on ice for tumor induction.

Each mouse was inoculated subcutaneously in the right flank with $0.5 \times 10^6$ of MC38 cells in PBS for tumor development. The treatments were started when the mean tumor size reached approximately 100-200 mm³ (no more than 200 mm³). Tumor sizes were measured twice weekly in two dimensions using a caliper, and the volume was expressed in mm³ using the formula: $V=0.5 \ a \times b^2$ where a and b are the long and short diameters of the tumor, respectively.

The mice were grouped and dosed as set forth in Table 24.

TABLE 24

Groups and doses for MC38 syngeneic study with anti-PDL1 activatable antibodie

| Group | Count | Treatment | Dose (mg/kg) | Dose volume (mL/kg) | Schedule | Route |
|---|---|---|---|---|---|---|
| 1 | 9 | mIgG2a (C1.18.4) | 5 | 10 | b.i.w.; 4 doses | IP |
| 2 | 9 | Anti-PDL1 (C5H9v2) | 5 | 10 | b.i.w.; 4 doses | IP |
| 3 | 9 | PL15-0003-C5H9v2 | 5 | 10 | b.i.w.; 4 doses | IP |
| 4 | 9 | PL15-2001-C5H9v2 | 5 | 10 | b.i.w.; 4 doses | IP |
| 5 | 9 | PL15-3001-C5H9v2 | 5 | 10 | b.i.w.; 4 doses | IP |

Figure 28:
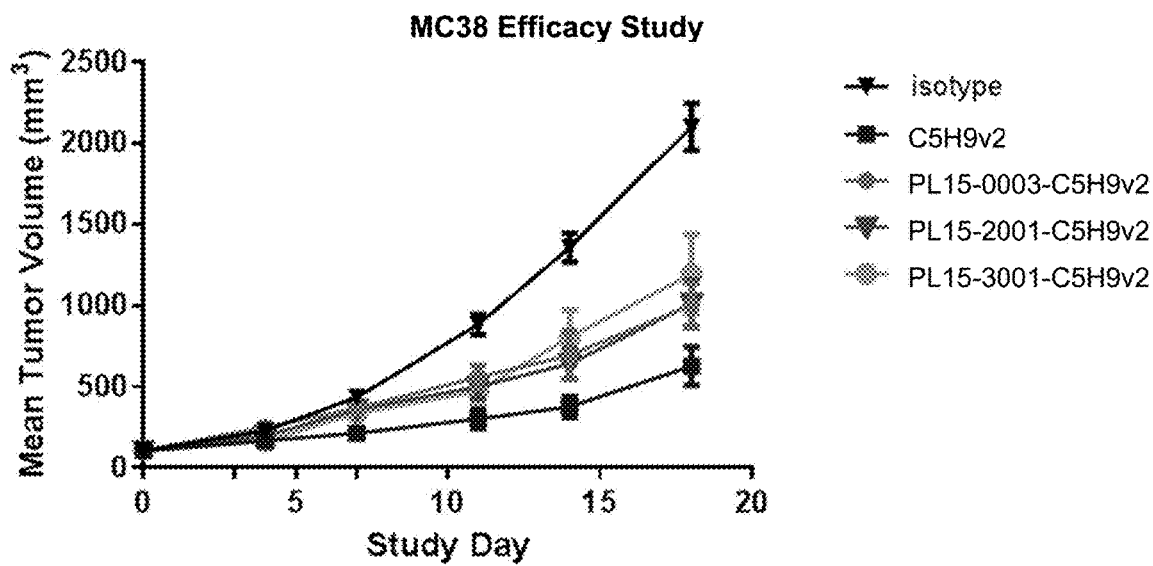
FIG. 28 is a graph depicting the ability of the anti-PDL1 activatable antibodies PL15-0003-05H9v2, PL15-2001-05H9v2, and PL15-3001-05H9v2 to inhibit the growth of MC38 syngeneic tumors similar to positive control anti-PDL1 antibody C5H9v2.

FIG. 28A, which plots tumor volume versus number of days post initial dose, demonstrates that anti-PDL1 activatable antibodies PL15-0003-05H9v2, PL15-2001-05H9v2, and PL15-3001-05H9v2 inhibited the growth of MC38 syngeneic tumors similar to positive control anti-PDL1 antibody C5H9v2.

Example 22. An Anti-PDL1 Activatable Antibody of the Disclosure Demonstrates Reduced PDL1 Occupancy in Blood from C57B1/6 Mice This example demonstrates that animals treated with anti-PDL1 activatable antibodies of the disclosure exhibited reduced binding to blood T cells from tumor bearing mice compared to that exhibited by an anti-PDL1 antibody of the disclosure.

The study was conducted in a manner similar to that described in Example 15. Briefly, mice bearing MC38 tumors between 100-200 mm³ were treated with a single dose of anti-PDL1 antibody C5H9v2 or anti-PDL1 activatable antibody PL15-0003-05H9v2, PL15-2001-05H9v2, or PL15-3001-05H9v2 as indicated in Table 25, and blood was analyzed for surface bound antibody by flow cytometry four and eight days after dosing. Percent occupancy was calculated as described in Example 15.

TABLE 25

Groups and doses for PDL1 occupancy study

| Group | Count | Treatment | Dose (mg/kg) | Dose volume (mL/kg) | Schedule | Route |
|---|---|---|---|---|---|---|
| 1 | 9 | mIgG2a (C1.18.4) | 5 | 10 | b.i.w.; 4 doses | IP |
| 2 | 9 | Anti-PD-L1 (C5H9v2) | 5 | 10 | b.i.w.; 4 doses | IP |
| 3 | 9 | Anti-PD-L1 (C5H9v2) | 3 | 10 | b.i.w.; 4 doses | IP |
| 4 | 9 | PL15-0003-C5H9v2 | 5 | 10 | b.i.w.; 4 doses | IP |
| 5 | 9 | PL15-0003-C5H9v2 | 3 | 10 | b.i.w.; 4 doses | IP |
| 6 | 9 | PL15-2001-C5H9v2 | 5 | 10 | b.i.w.; 4 doses | IP |
| 7 | 9 | PL15-2001-C5H9v2 | 3 | 10 | b.i.w.; 4 doses | IP |

TABLE 25-continued

Groups and doses for PDL1 occupancy study

| Group | Count | Treatment | Dose (mg/kg) | Dose volume (mL/kg) | Schedule | Route |
|---|---|---|---|---|---|---|
| 8 | 9 | PL15-3001-C5H9v2 | 5 | 10 | b.i.w.; 4 doses | IP |
| 9 | 9 | PL15-3001-C5H9v2 | 3 | 10 | b.i.w.; 4 doses | IP |

Figure 29A:
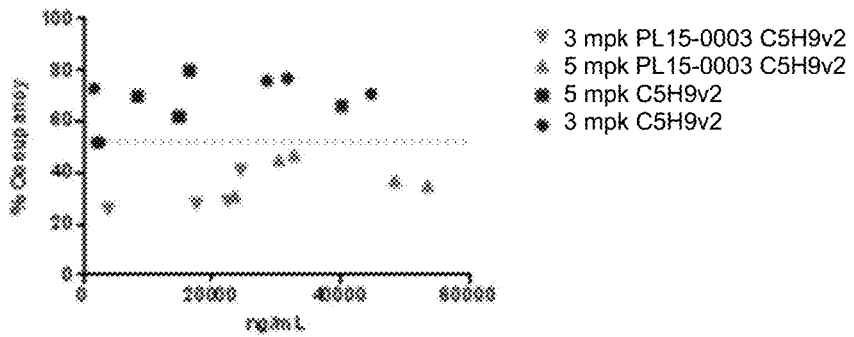
FIGS. 29A, 29B, and 29C are a series of graphs depicting that the presence of tumor-derived proteases capable of cleaving the activatable antibodies anti-PDL1 antibody C5H9v2 or anti-PDL1 activatable antibody PL15-0003-05H9v2, PL15-2001-05H9v2, or PL15-3001-05H9v2 did not lead to high levels of activated activatable antibodies in the blood.
Figure 29A:
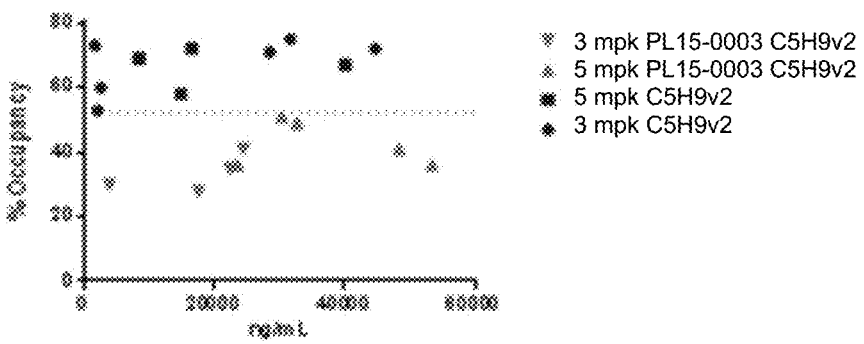
Figure 29B:
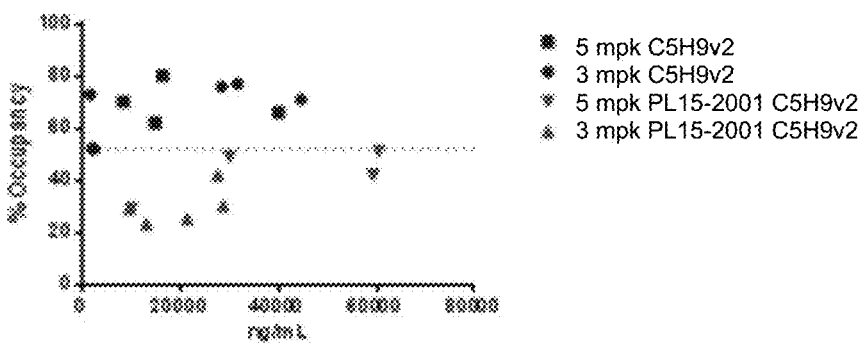
Figure 29B:
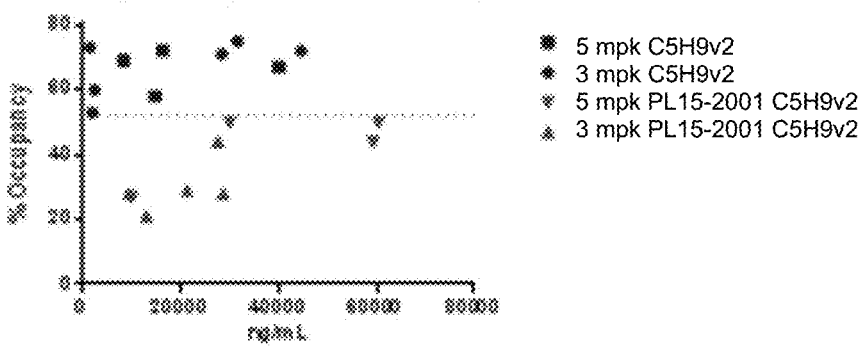
Figure 29C:
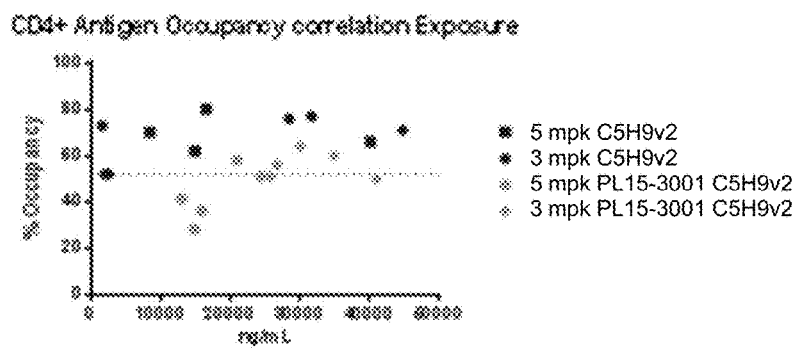
Figure 29C:
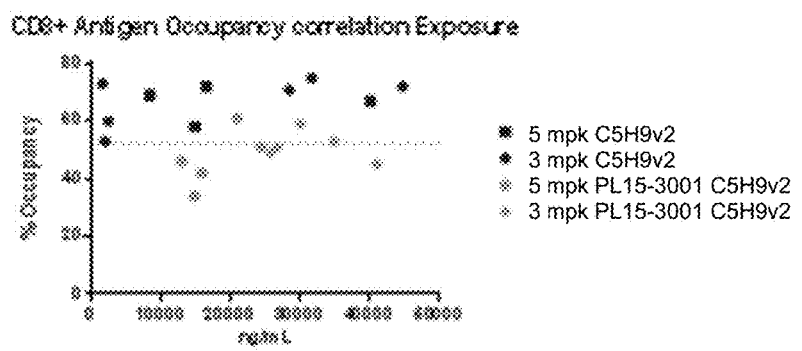

Plasma concentrations of the antibody and activatable antibodies were determined by ELISA. FIGS. 29A to C demonstrate that the presence of tumor-derived proteases capable of cleaving the activatable antibodies did not lead to high levels of activated activatable antibodies in the blood.

Example 23. In Vivo Imaging of an Anti-PDL1 Activatable Antibody of the Disclosure This Example demonstrates the ability of proteases in a tumor implanted into a mouse to activate an anti-PDL1 activatable antibody of the disclosure.

Figure 30:
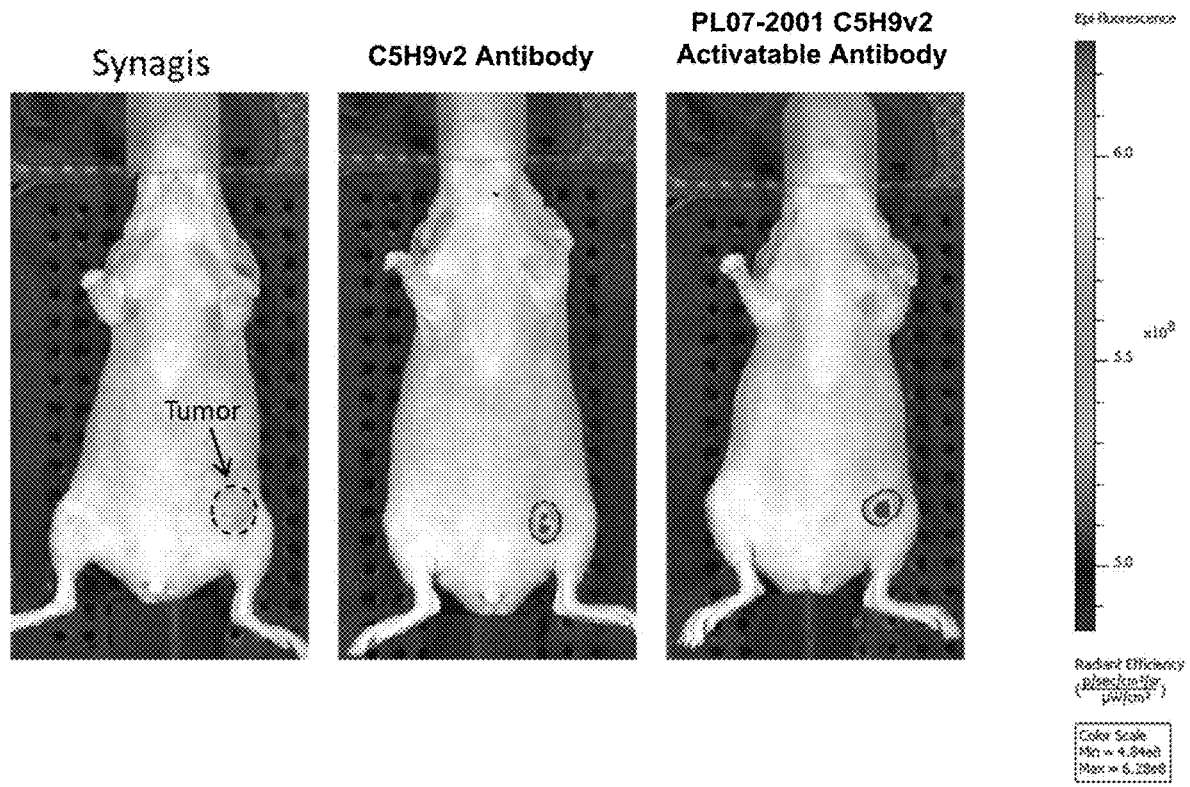
FIG. 30 is an illustration depicting the ability of proteases in a tumor implanted into a mouse to activate the anti-PDL1 activatable antibody PL07-2001-05H9v2.

A MDA-MB-231-luc2 orthotopic xenograft breast cancer model was used for these studies. Female nu/nu mice were purchased from Charles River Laboratories to arrive at 7 week old. After 1 week acclimation, three million MDA-MD-231-luc2-4D3LN cells (Perkin Elmer) in 30 microliters (ul, also referred to herein as "µl") serum-free RPMI (1:1 matrigel) were injected into the fourth abdominal left mammary fat pad. Tumors were grown to 110-159 $mm^3$. Three mice per group were administered intravenously 5 mg/kg Alexa750-conjugated anti-PDL1 antibody C5H9v2 or anti-PDL1 activatable antibody PL07-2001-05H9v2. Four mice were administered intravenously 5 mg/kg Alexa750-conjugated anti-RSV antibody control palivizumab (Synagis). Ninety-six hours after administration, optical images were collected from each of the mice. Results are shown in FIG. 30A. A high-intensity fluorescent signal was detected only in the tumors of mice dosed with the anti-PDL1 antibody or anti-PDL1 activatable antibody PL07-2001-05H9v2, suggesting that the anti-PDL1 activatable antibody was activated and accumulated in the tumor through PDL1 binding.

Example 24. Activation of an Activatable Antibody of the Disclosure in Human Plasma Samples This Example determines whether an activatable antibody of the disclosure is activated in human plasma samples.

Anti-PDL1 activatable antibody PL07-2001-05H9v2 was conjugated with Oregon Green dye (ThermoFisher Cat #06149). The concentration and degree of labeling was determined with a spectrophotometer. Three uM (also referred to herein as "µM") of labeled anti-PDL1 activatable antibody PL07-2001-05H9v2 was added into plasma samples obtained from healthy donors, patients with melanoma or lung cancer patients in a final activatable antibody to plasma ratio of 30:70. The samples were incubated for 48 hours in a 37° C. humidifying chamber. Reactions of labeled anti-PDL1 activatable antibody PL07-2001-05H9v2 in plasma were stopped at either 0 or 48 hours by freezing samples in −80° C. or denaturing in Wes running buffer (ProteinSimple Cat # PS-MK14). Samples were analyzed by the Wes capillary western blot system (ProteinSimple) using antibodies against Oregon Green dye (ThermoFisher Cat # A-11095 at 100 m/rill) followed by HRP conjugated secondary antibody (Jackson ImmunoResearch Cat #705-035-147 at 1/40 dilution). Analysis of percent activation of the labeled anti-PDL1 activatable antibody PL07-2001-05H9v2 was determined using Compass (ProteinSimple) software.

There was no detectable activatable antibody activation in five normal patient samples, in five melanoma patient samples (three metastases in lymph nodes, two in the brain, and one on the skin of the back), nor in five lung cancer patient samples (one metastasis in the lower lobe of the left lung (stage IV), one in the lower lobe of the right lung (stage IV), one in the upper lobe of the left lung (stage IA), and two in the upper lobe of the right lung (stages IIIA and IB).

OTHER EMBODIMENTS

While the invention has been described in conjunction with the detailed description thereof, the foregoing description is intended to illustrate and not limit the scope of the invention, which is defined by the scope of the appended claims. Other aspects, advantages, and modifications are within the scope of the following.

SEQUENCE LISTING (1204 sequences)

SEQ ID NO: 1 - DNA, 720 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagatattactgcgtcgggttagaggacaacgtacgcagactccgtgaagggccggttcaccatctccagagacaattccaagaacacgctgtatctgcaaatgaacagcctgagagccgaggacacggccgtatattactgtgcgagatcgaagattgcttttgactactggggccagggaaccctggtcaccgtctcgagcggtggaggcggttcaggcggaggtggcagcggcggtggcgggtcgacggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctataaggcatcccgtttgcaaagtggggtcccatcaaggttcagtggcagtggatctgggacagatttcactctcaccatcagcagtctgcaacctgaagattttgcaacttactactgtcaacagcgtgcgcttaagcctgtgacgttcggccaagggaccaaggtggaaatcaaacgg

SEQ ID NO: 2 - protein, 240 aa, Artificial Sequence
  Description of Artificial Sequence: chemically synthesized sequence
EVQLLESGGGLVQPGGSLRLSCAASGFTFSSYAMSWVRQAPGKGLEWVSDITASGQRTTYADSVKGRFTISRDNSKNTLYLQMNSLRAEDTAVYYCARSKIAFDYWGQGTLVTVSSGGGGSGGGGSGGGGSTDIQMTQSPSSLSASVGDRVTITCRASQSISSYLNWYQQKPGKAPKLLIYKASRLQSGVPSRFSGSGSGTDFTLTISSLQPEDFATYYCQQRALKPVTFGQGTKVEIKR

SEQ ID NO: 3 - DNA, 720 bp, Artificial Sequence
  Description of Artificial Sequence: chemically synthesized sequence
gaggtgcagctgttggagtctgggggaggcttggtacagcctggggggtccctgagactatcctgtgcagcctctggattcacctttagcagctatgccatgagctgggtccgccaggctccagggaaggggctggagtgggtctcaagtattaataaggatggtcattatacaagttacgcagactccgtgaagggccggttcaccatctccagagacaattccaagaacacgctgtatctgcaaatgaacagcctgagagccgaggacacggccgtatattactgtgcgaaaaatcttgatgagtttgactactggggccagggaaccctggtcaccgtctcgagcggtggaggcggttcaggcggaggtggcagcggcggtggcgggtcgacggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctaatacgttcggccaagggaccaaggtggaaatcaaacgg

SEQ ID NO: 4 - protein, 240 aa, Artificial Sequence
  Description of Artificial Sequence: chemically synthesized sequence
EVQLLESGGGLVQPGGSLRLSCAASGFTFSSYAMSWVRQAPGKGLEWVSSINKDGHYTSYADSVKGRFTISRDNSKNTLYLQMNSLRAEDTAVYYCAKNLDEFDYWGQGTLVTVSSGGGGSGGGGSGGGGSTDIQMTQSPSSLSASVGDRVTITCRASQSISSYLNWYQQKPGKAPKLLIYAASSLQSGVPSRFSGSGSGTDFTLTISSLQPEDFATYYCQQSYSTPNTFGQGTKVEIKR

SEQ ID NO: 5 - DNA, 720 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcatctattatggctactggtgctggtacattgtacgcagactccgtgaagggccggttcaccatctccagagacaattccaagaacacgctgtatctgcaaatgaacagcctgagagccgaggacacggccgtatattactgtgcgaaagatggtgcggggtttgactactggggccagggaaccctggtcaccgtctcgagcggtggaggcggttcaggcggaggtggcagcggcggtggcgggtcgacggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctattctgcatcccagttgcaaagtggggtcccatcaaggttcagtggcagtggatctgggacagatttcactctcaccatcagcagtctgcaacctgaagattttgcaacttactactgtcaacaggcgaattcgcggccttctacgttcggccaagggaccaaggtggaaatcaaacgg

SEQ ID NO: 6 - protein, 240 aa, Artificial Sequence
  Description of Artificial Sequence: chemically synthesized sequence
EVQLLESGGGLVQPGGSLRLSCAASGFTFSSYAMSWVRQAPGKGLEWVSSIMATGAGTLYADSVKGRFTISRDNSKNTLYLQMNSLRAEDTAVYYCAKDGAGFDYWGQGTLVTVSSGGGGSGGGGSGGGGSTDIQMTQSPSSLSASVGDRVTITCRASQSISSYLNWYQQKPGKAPKLLIYSASQLQSGVPSRFSGSGSGTDFTLTISSLQPEDFATYYCQQANSRPSTFGQGTKVEIKR

SEQ ID NO: 7 - DNA, 720 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctgtagtgggtctcaactattacttcttctggtgctgctacatattacgcagactccgtgaagggccggttcaccatctccagagacaattccaagaacacgctgtatctgcaaatgaacagcctgagagccgaggacacggccgtatattactgtgcgaaaaattatactggttttgactactggggccagggaaccctggtcaccgtctcgagcggtggaggcggttcaggcggaggtggcagcggcggtggcgggtcgacggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctataatgcatcctccttgcaaagtggggtcccatcaaggttcagtggcagtggatctgggacagatttcactctcaccatcagcagtctgcaacctgaagattttgcaacttactactgtcaacagtatacttatggtcctggtacgttcggccaagggaccaaggtggaaatcaaacgg

SEQ ID NO: 8 - protein, 240 aa, Artificial Sequence
  Description of Artificial Sequence: chemically synthesized sequence
EVQLLESGGGLVQPGGSLRLSCAASGFTFSSYAMSWVRQAPGKGLQWVSTITSSGAATYYADSVKGRFTISRDNSKNTLYLQMNSLRAEDTAVYYCAKNYTGFDYWGQGTLVTVSSGGGGSGGGGSGGGGSTDIQMTQSPSSLSASVGDRVTITCRASQSISSYLNWYQQKPGKAPKLLIYNASSLQSGVPSRFSGSGSGTDFTLTISSLQPEDFATYYCQQYTYGPGTFGQGTKVEIKR

SEQ ID NO: 9 - DNA, 720 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttattctactggtggtgctacagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagcggtggaggcggttcaggcggaggtggcagcggcggtggcgggtcgacggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctattatgcatccactttgcaaagtggggtcccatcaaggttcagtggcagtggatctgggacagatttcactctcaccatcagcagtctgcaacctgaagattttgcaacttactactgtcaacaggataatggttatccttctacgttcggccaagggaccaaggtggaaatcaaacgg

SEQ ID NO: 10 - protein, 240 aa, Artificial Sequence
  Description of Artificial Sequence: chemically synthesized sequence
EVQLLESGGGLVQPGGSLRLSCAASGFTFSSYAMSWVRQAPGKGLEWVSSIYSTGGATAYADSVKGRFTISRDNSKNTLYLQMNSLRAEDTAVYYCAKSSAGFDYWGQGTLVTVSSGGGGSGGGGSGGGGSTDIQMTQSPSSLSASVGDRVTITCRASQSISSYLNWYQQKPGKAPKLLIYYASTLQSGVPSRFSGSGSGTDFTLTISSLQPEDFATYYCQQDNGYPSTFGQGTKVEIKR

SEQ ID NO: 11 - DNA, 324 bp, Artificial Sequence
  Description of Artificial Sequence: chemically synthesized sequence
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctattatgcatccactttgcaaagtggggtcccatcaaggttcagtggcagtggatctgggacagatttcactctcaccatcagcagtctgcaacctgaagattttgcaacttactactgtcaacaggataatggttatccttctacgttcggccaagggaccaaggtggaaatcaaacgg

SEQ ID NO: 12 - protein, 108 aa, Artificial Sequence
  Description of Artificial Sequence: chemically synthesized sequence
DIQMTQSPSSLSASVGDRVTITCRASQSISSYLNWYQQKPGKAPKLLIYYASTLQSGVPSRFSGSGSGTDFTLTISSLQPEDFATYYCQQDNGYPSTFGQGTKVEIKR

SEQ ID NO: 13 - DNA, 360 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttattctactggtggtgctacagcttacgcagactccgtgaagggccggttcaccatctccagagacaattccaagaacacgctgtatctgcaaatgaacagcctgagagccgaggacacggccgtatattactgtgcgaaatcttctgctggtagtcggccgggttttgactactggggccagggaaccctggtcaccgtctcgagc

SEQ ID NO: 14 - protein, 121 aa, Artificial Sequence
  Description of Artificial Sequence: chemically synthesized sequence
EVQLLESGGGLVQPGGSLRLSCAASGFTFSSYAMSWVRQAPGKGLEWVSSIYSTGGATAYADSVKGRFTISRDNSKNTLYLQMNSLRAEDTAVYYCAKSSAGQSRPGFDYWGQGTLVTVSS

SEQ ID NO: 15 - DNA, 360 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttattctactggtggtgctacagcttacgcagactccgtgaagggccggttcaccatctccagagacaattccaagaacacgctgtatctgcaaatgaacagcctgagagccgaggacacggccgtatattactgtgcgaaatcttctgctggttcgtggccgggttttgactactggggccagggaaccctggtcaccgtctcgagc

SEQ ID NO: 16 - protein, 121 aa, Artificial Sequence
  Description of Artificial Sequence: chemically synthesized sequence
EVQLLESGGGLVQPGGSLRLSCAASGFTFSSYAMSWVRQAPGKGLEWVSSIYSTGGATAYADSVKGRFTISRDNSKNTLYLQMNSLRAEDTAVYYCAKSSAGQSWPGFDYWGQGTLVTVSS

SEQ ID NO: 17 - DNA, 363 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttattctactggtggtgctacagcttacgcagactccgtgaagggccggttcaccatctccagagacaattccaagaacacgctgtatctgcaaatgaacagcctgagagccgaggacacggccgtatattactgtgcgaaatcttctgctggtcagtcgtttccgggttttgactactggggccagggaaccctggtcaccgtctcgagc

SEQ ID NO: 18 - protein, 121 aa, Artificial Sequence
  Description of Artificial Sequence: chemically synthesized sequence
EVQLLESGGGLVQPGGSLRLSCAASGFTFSSYAMSWVRQAPGKGLEWVSSIYSTGGATAYADSVKGRFTISRDNSKNTLYLQMNSLRAEDTAVYYCAKSSAGQSFPGFDYWGQGTLVTVSS

SEQ ID NO: 19 - DNA, 348 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttattctactggtggtgctacagcttacgcagactccgtgaagggccggttcaccatctccagagacaattccaagaacacgctgtatctgcaaatgaacagcctgagagccgaggacacggccgtatattactgtgcgaaatggtctgctgcttttgactactggggccagggaaccctggtcaccgtctcgagc

SEQ ID NO: 20 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIYSTGGATAYADSVKGRFTISRDNSKNTLYLQMNSLRAEDTAVYYCAKWSAAFDYWGQGTLVTVSS

SEQ ID NO: 21 - DNA, 348 bp, Artificial Sequence; identical to SEQ ID NO: 19
  Description of Artificial Sequence: chemically synthesized sequence

SEQ ID NO: 22 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIYSTGGATAYADSVKGRFTISRDNSKNTLYLQMNSLRAEDTAVYYCAKWSAGYDYWGQGTLVTVSS

SEQ ID NO: 23 - DNA, 348 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttattctactggtggtgctacagcttacgcagactccgtgaagggccggttcaccatctccagagacaattccaagaacacgctgtatctgcaaatgaacagcctgagagccgaggacacggccgtatattactgtgcgaaatggtctaagggttttgactactggggccagggaaccctggtcaccgtctcgagc

SEQ ID NO: 24 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIYSTGGATAYADSVKGRFTISRDNSKNTLYLQMNSLRAEDTAVYYCAKWSKGFDYWGQGTLVTVSS

SEQ ID NO: 25 - DNA, 352 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttggaagtagggtattgtgacagtgagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagc

SEQ ID NO: 26 - protein, 113 aa, Artificial Sequence
  Description of Artificial Sequence: chemically synthesized sequence
EVQLLESGGGLVQPGGSLRLSCAASGFTFSSYAMSWVRQAPGKGLEWVSSIWKQGIVTVYDSVKGRFTISRDNSKNTLYLQMNSLRAEDTAVYYCAKSSAGFDYWGQGTLVTV

SEQ ID NO: 27 - DNA, 352 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttggcggaatggtattgttacagttagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagc

SEQ ID NO: 28 - protein, 115 aa, Artificial Sequence
  Description of Artificial Sequence: chemically synthesized sequence
EVQLLESGGGLVQPGGSLRLSCAASGFTFSSYAMSWVRQAPGKGLEWVSSIWRNGIVTVYDSVKGRFTISRDNSKNTLYLQMNSLRAEDTAVYYCAKSSAGFDYWGQGTLVTVSS

SEQ ID NO: 29 - DNA, 352 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagatatttggaagtagggtatggttacagtgagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagc

SEQ ID NO: 30 - protein, 115 aa, Artificial Sequence
  Description of Artificial Sequence: chemically synthesized sequence
EVQLLESGGGLVQPGGSLRLSCAASGFTFSSYAMSWVRQAPGKGLEWVSDIWKQGMVTVYDSVKGRFTISRDNSKNTLYLQMNSLRAEDTAVYYCAKSSAGFDYWGQGTLVTVSS

SEQ ID NO: 31 - DNA, 352 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcatcgatttggaggtagggtctggcgacagcgagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagc

SEQ ID NO: 32 - protein, 115 aa, Artificial Sequence
  Description of Artificial Sequence: chemically synthesized sequence
EVQLLESGGGLVQPGGSLRLSCAASGFTFSSYAMSWVRQAPGKGLEWVSSIWRQGLATAYDSVKGRFTISRDNSKNTLYLQMNSLRAEDTAVYYCAKSSAGFDYWGQGTLVTVSS

SEQ ID NO: 33 - DNA, 352 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagagattgtggctactggtattttgacaagtagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagc

SEQ ID NO: 34 - protein, 115 aa, Artificial Sequence
  Description of Artificial Sequence: chemically synthesized sequence
EVQLLESGGGLVQPGGSLRLSCAASGFTFSSYAMSWVRQAPGKGLEWVSEIVATGILTSYDSVKGRFTISRDNSKNTLYLQMNSLRAEDTAVYYCAKSSAGFDYWGQGTLVTVSS

SEQ ID NO: 35 - DNA, 352 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcatcgattggtcggtagggtttgattacagttagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagc

SEQ ID NO: 36 - protein, 115 aa, Artificial Sequence
  Description of Artificial Sequence: chemically synthesized sequence
EVQLLESGGGLVQPGGSLRLSCAASGFTFSSYAMSWVRQAPGKGLEWVSSIGRQGLITVYDSVKGRFTISRDNSKNTLYLQMNSLRAEDTAVYYCAKSSAGFDYWGQGTLVTVSS

SEQ ID NO: 37 - DNA, 352 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcatctatttggtattagggtctggtgacagttagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagc

SEQ ID NO: 38 - protein, 115 aa, Artificial Sequence
  Description of Artificial Sequence: chemically synthesized sequence
EVQLLESGGGLVQPGGSLRLSCAASGFTFSSYAMSWVRQAPGKGLEWVSSIWYQGLVTVYDSVKGRFTISRDNSKNTLYLQMNSLRAEDTAVYYCAKSSAGFDYWGQGTLVTVSS

SEQ ID NO: 39 - DNA, 352 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagatatttggaagtagggttttgctacagcgagcttacgcagactccgtgaagggccggttcaccatctccagagacaattccaagaacacgctgtatctgcaaatgaacagcctgagagccgaggacacggccgtatattactgtgcgaaatcttctgctggttttgactactggggccagggaaccctggtcaccgtctcgagc

SEQ ID NO: 40 - protein, 114 aa, Artificial Sequence
  Description of Artificial Sequence: chemically synthesized sequence
EVQLLESGGGLVQPGGSLRLSCAASGFTFSSYAMSWVRQAPGKGLEWVSDIWKQGFATADSVKGRFTISRDNSKNTLYLQMNSLRAEDTAVYYCAKSSAGFDYWGQGTLVTVSS

SEQ ID NO: 41 - DNA, 352 bp, Artificial Sequence; identical to SEQ ID NO: 25
  Description of Artificial Sequence: chemically synthesized sequence

SEQ ID NO: 42 - protein, 115 aa, Artificial Sequence
  Description of Artificial Sequence: chemically synthesized sequence
EVQLLESGGGLVQPGGSLRLSCAASGFTFSSYAMSWVRQAPGKGLEWVSSIWKQGIVTVYDSVKGRFTISRDNSKNTLYLQMNSLRAEDTAVYYCAKSSAGFDYWGQGTLVTVSS

SEQ ID NO: 43 - DNA, 352 bp, Artificial Sequence; identical to SEQ ID NO: 31
  Description of Artificial Sequence: chemically synthesized sequence

SEQ ID NO: 44 - protein, 115 aa, Artificial Sequence; identical to SEQ ID NO: 32
  Description of Artificial Sequence: chemically synthesized sequence

SEQ ID NO: 45 - DNA, 348 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttggcggaatggtattgttacagtttacgcagactccgtgaagggccggttcaccatctccagagacaattccaagaacacgctgtatctgcaaatgaacagcctgagagccgaggacacggccgtatattactgtgcgaaatggtctgctgcttttgactactggggccagggaaccctggtcaccgtctcgagc

SEQ ID NO: 46 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSS

SEQ ID NO: 47 - DNA, 348 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttggcggaatggtattgttacagtttacgcagactccgtgaagggccggttcaccatctccagagacaattccaagaacacgctgtatctgcaaatgaacagcctgagagccgaggacacggccgtatattactgtgcgaaatggtctgctggttatgactactggggccagggaaccctggtcaccgtctcgagc

SEQ ID NO: 48 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAGYDYWGQGTLVTVSS

SEQ ID NO: 49 - DNA, 348 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaagtatttggcggaatggtattgttacagtttacgcagactccgtgaagggccggttcaccatctccagagacaattccaagaacacgctgtatctgcaaatgaacagcctgagagccgaggacacggccgtatattactgtgcgaaatggtctaagggttttgactactggggccagggaaccctggtcaccgtctcgagc

SEQ ID NO: 50 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSKGFDYWGQGTLVTVSS

SEQ ID NO: 51 - DNA, 348 bp, Artificial Sequence
  Description of Artificial Sequence: chemically synthesized sequence
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcatctatttggtatcagggtctggtgacagtttacgcagactccgtgaagggccggttcaccatctccagagacaattccaagaacacgctgtatctgcaaatgaacagcctgagagccgaggacacggccgtatattactgtgcgaaatggtctgctgcttttgactactggggccagggaaccctggtcaccgtctcgagc

SEQ ID NO: 52 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIWYQGLVTVYADSVKGRFTISRDNSKNTLYLQMNSLRAEDTAVYYCAKWSAAFDYWGQGTLVTVSS

SEQ ID NO: 53 - DNA, 348 bp, Artificial Sequence; identical to SEQ ID NO: 47
  Description of Artificial Sequence: chemically synthesized sequence

SEQ ID NO: 54 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIWYQGLVTVYADSVKGRFTISRDNSKNTLYLQMNSLRAEDTAVYYCAKWSAGYDYWGQGTLVTVSS

SEQ ID NO: 55 - DNA, 348 bp, Artificial Sequence; identical to SEQ ID NO: 49
  Description of Artificial Sequence: chemically synthesized sequence

SEQ ID NO: 56 - protein, 116 aa, Artificial Sequence
  Description of Artificial Sequence: chemically synthesized sequence
EVQLLESGGGLVQPGGSLRLSCAASGFTFSSYAMSWVRQAPGKGLEWVSSIWYQGLVTVYADSVKGRFTISRDNSKNTLYLQMNSLRAEDTAVYYCAKWSKGFDYWGQGTLVTVSS

SEQ ID NO: 57 - DNA, 324 bp, Artificial Sequence
  Description of Artificial Sequence: chemically synthesized sequence
gatattcagatgacccagagcccgagcagcctgagcgcgagcgtgggcgatcgcgtgaccattacctgccgcgcgagccagagcattagcagctatctgaactggtatcagcagaaaccgggcaaagcgccgaaactgctgatttatgcggcgagcagcctgcagagcggcgtgccgagccgctttagcggcagcggcagcggcaccgattttaccctgaccattagcagcctgcagccggaagattttgcgacctattattgccagcaggataacggctatccgagcacctttggcggcggcaccaaagtggaaattaaacgc

SEQ ID NO: 58 - protein, 108 aa, Artificial Sequence
  Description of Artificial Sequence: chemically synthesized sequence
DIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 59 - protein, 15 aa, Artificial Sequence
  Description of Artificial Sequence: chemically synthesized sequence
LCEVLMLLQHPWCMG

SEQ ID NO: 60 - protein, 15 aa, Artificial Sequence
  Description of Artificial Sequence: chemically synthesized sequence
IACRHFMEQLPFCHH

SEQ ID NO: 61 - protein, 15 aa, Artificial Sequence
  Description of Artificial Sequence: chemically synthesized sequence
FGPRCGEASTCVPYE

SEQ ID NO: 62 - protein, 15 aa, Artificial Sequence
  Description of Artificial Sequence: chemically synthesized sequence
ILYCDSWGAGCLTRP

SEQ ID NO: 63 - protein, 15 aa, Artificial Sequence
  Description of Artificial Sequence: chemically synthesized sequence
GIALCPSHFCQLPQT

SEQ ID NO: 64 - protein, 15 aa, Artificial Sequence
  Description of Artificial Sequence: chemically synthesized sequence
DGPRCFVSGECSPIG

SEQ ID NO: 65 - protein, 15 aa, Artificial Sequence
  Description of Artificial Sequence: chemically synthesized sequence
LCYKLDYDDRSYCHI

SEQ ID NO: 66 - protein, 15 aa, Artificial Sequence
  Description of Artificial Sequence: chemically synthesized sequence
PCHPHPYDARPYCNV

SEQ ID NO: 67 - protein, 15 aa, Artificial Sequence
  Description of Artificial Sequence: chemically synthesized sequence
PCYWHPFFAYRYCNT

SEQ ID NO: 68 - protein, 15 aa, Artificial Sequence
  Description of Artificial Sequence: chemically synthesized sequence
VCYYMDWLGRNWCSS

SEQ ID NO: 69 - protein, 15 aa, Artificial Sequence
  Description of Artificial Sequence: chemically synthesized sequence
LCDLFKLREFPYCMG

SEQ ID NO: 70 - protein, 15 aa, Artificial Sequence
  Description of Artificial Sequence: chemically synthesized sequence
YLPCHFVPIGACNNK

SEQ ID NO: 71 - protein, 15 aa, Artificial Sequence
  Description of Artificial Sequence: chemically synthesized sequence
IFCHMGVVVPQCANY

SEQ ID NO: 72 - protein, 15 aa, Artificial Sequence
  Description of Artificial Sequence: chemically synthesized sequence
ACHPHPYDARPYCNV

SEQ ID NO: 73 - protein, 15 aa, Artificial Sequence
  Description of Artificial Sequence: chemically synthesized sequence
PCHPAPYDARPYCNV

SEQ ID NO: 74 - protein, 15 aa, Artificial Sequence
  Description of Artificial Sequence: chemically synthesized sequence
PCHPHAYDARPYCNV

SEQ ID NO: 75 - protein, 15 aa, Artificial Sequence
  Description of Artificial Sequence: chemically synthesized sequence
PCHPHPADARPYCNV

SEQ ID NO: 76 - protein, 15 aa, Artificial Sequence
  Description of Artificial Sequence: chemically synthesized sequence
PCHPHPYAARPYCNV

SEQ ID NO: 77 - protein, 15 aa, Artificial Sequence
  Description of Artificial Sequence: chemically synthesized sequence
PCHPHPYDAAPYCNV

SEQ ID NO: 78 - protein, 15 aa, Artificial Sequence
  Description of Artificial Sequence: chemically synthesized sequence
PCHPHPYDARPACNV

SEQ ID NO: 79 - protein, 15 aa, Artificial Sequence
  Description of Artificial Sequence: chemically synthesized sequence
PCHPHPYDARPYCAV

SEQ ID NO: 80 - protein, 15 aa, Artificial Sequence
  Description of Artificial Sequence: chemically synthesized sequence
PCHAHPYDARPYCNV

SEQ ID NO: 81 - protein, 15 aa, Artificial Sequence
  Description of Artificial Sequence: chemically synthesized sequence
PCHPHPYDARAYCNV

SEQ ID NO: 82 - DNA, 534 bp, Artificial Sequence
  Description of Artificial Sequence: chemically synthesized sequence
caaggtcagtctggatcctattgcgaggttagtgagctgtttgttcttccttggtgcatgggtggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 83 - protein, 157 aa, Artificial Sequence
  Description of Artificial Sequence: chemically synthesized sequence
QGQSGSYCEVSELFVLPWCMGGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 84 - DNA, 534 bp, Artificial Sequence
  Description of Artificial Sequence: chemically synthesized sequence
caaggtcagtctggatcctcttgccttatgcatccgcattatgctcatgattattgctatgttggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 85 - protein, 157 aa, Artificial Sequence
  Description of Artificial Sequence: chemically synthesized sequence
QGQSGSSCLMHPHYAHDYCYVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 86 - DNA, 534 bp, Artificial Sequence
  Description of Artificial Sequence: chemically synthesized sequence
caaggtcagtctggatccttgtgcgaggttttgatgttgttgcagcatccgtggtgcatggggggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 87 - protein, 157 aa, Artificial Sequence
  Description of Artificial Sequence: chemically synthesized sequence
QGQSGSLCEVLMLLQHPWCMGGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 88 - DNA, 534 bp, Artificial Sequence
  Description of Artificial Sequence: chemically synthesized sequence
caaggtcagtctggatccattgcgtgccggcattttatggagcagttgccgttttgccatcatggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 89 - protein, 157 aa, Artificial Sequence
  Description of Artificial Sequence: chemically synthesized sequence
QGQSGSIACRHFMEQLPFCHHGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 90 - DNA, 534 bp, Artificial Sequence
  Description of Artificial Sequence: chemically synthesized sequence
caaggtcagtctggatcctttggtcctaggtgcggtgaggcttctacttgcgttccgtatgagggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 91 - protein, 157 aa, Artificial Sequence
  Description of Artificial Sequence: chemically synthesized sequence
QGQSGSFGPRCGEASTCVPYEGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 92 - DNA, 534 bp, Artificial Sequence
  Description of Artificial Sequence: chemically synthesized sequence
caaggtcagtctggatccattctttattgcgatagttggggggcggggtgcttgacgcggccgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 93 - protein, 157 aa, Artificial Sequence
  Description of Artificial Sequence: chemically synthesized sequence
QGQSGSILYCDSWGAGCLTRPGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 94 - DNA, 534 bp, Artificial Sequence
  Description of Artificial Sequence: chemically synthesized sequence
caaggtcagtctggatccgggattgcgttgtgcccgtctcatttttgccagctgcctcagactggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 95 - protein, 157 aa, Artificial Sequence
  Description of Artificial Sequence: chemically synthesized sequence
QGQSGSGIALCPSHFCQLPQTGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 96 - DNA, 534 bp, Artificial Sequence
  Description of Artificial Sequence: chemically synthesized sequence
caaggtcagtctggatccgatgggccgcgttgctttgtgtcgggggagtgctctccgattggtggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 97 - protein, 157 aa, Artificial Sequence
  Description of Artificial Sequence: chemically synthesized sequence
QGQSGSDGPRCFVSGECSPIGGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 98 - DNA, 534 bp, Artificial Sequence
  Description of Artificial Sequence: chemically synthesized sequence
caaggtcagtctggatccttgtgctataagctggattatgatgataggtcttattgccatattggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 99 - protein, 157 aa, Artificial Sequence
  Description of Artificial Sequence: chemically synthesized sequence
QGQSGSLCYKLDYDDRSYCHIGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 100 - DNA, 534 bp, Artificial Sequence
  Description of Artificial Sequence: chemically synthesized sequence
caaggtcagtctggatccccgtgccatccgcatccttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 101 - protein, 157 aa, Artificial Sequence
  Description of Artificial Sequence: chemically synthesized sequence
QGQSGSPCHPHPYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 102 - DNA, 534 bp, Artificial Sequence
  Description of Artificial Sequence: chemically synthesized sequence
caaggtcagtctggatccccttgctattggcatcctttttttgcgtataggtattgcaatactggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 103 - protein, 157 aa, Artificial Sequence
  Description of Artificial Sequence: chemically synthesized sequence
QGQSGSPCYWHPFFAYRYCNTGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 104 - DNA, 534 bp, Artificial Sequence
  Description of Artificial Sequence: chemically synthesized sequence
caaggtcagtctggatccgtttgctattatatggattggttggggcggaattggtgctcttcgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 105 - protein, 157 aa, Artificial Sequence
  Description of Artificial Sequence: chemically synthesized sequence
QGQSGSVCYYMDWLGRNWCSSGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 106 - DNA, 534 bp, Artificial Sequence
  Description of Artificial Sequence: chemically synthesized sequence
caaggtcagtctggatccctgtgcgatctgtttaagttgcgtgagtttccttattgcatggggggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 107 - protein, 157 aa, Artificial Sequence
  Description of Artificial Sequence: chemically synthesized sequence
QGQSGSLCDLFKLREFPYCMGGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 108 - DNA, 534 bp, Artificial Sequence
  Description of Artificial Sequence: chemically synthesized sequence
caaggtcagtctggatcctatcttccgtgccattttgttccgattggggcttgcaataataagggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 109 - protein, 157 aa, Artificial Sequence
  Description of Artificial Sequence: chemically synthesized sequence
QGQSGSYLPCHFVPIGACNNKGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 110 - DNA, 534 bp, Artificial Sequence
  Description of Artificial Sequence: chemically synthesized sequence
caaggtcagtctggatccattttttgccatatgggtgttgtggttcctcagtgcgcgaattatggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 111 - protein, 157 aa, Artificial Sequence
  Description of Artificial Sequence: chemically synthesized sequence
QGQSGSIFCHMGVVVPQCANYGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 112 - DNA, 534 bp, Artificial Sequence
  Description of Artificial Sequence: chemically synthesized sequence
caaggtcagtctggatccgcgtgccatccgcatccttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 113 - protein, 157 aa, Artificial Sequence
  Description of Artificial Sequence: chemically synthesized sequence
QGQSGSACHPHPYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 114 - DNA, 534 bp, Artificial Sequence
  Description of Artificial Sequence: chemically synthesized sequence
caaggtcagtctggatccccgtgccatccggctccttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 115 - protein, 157 aa, Artificial Sequence
  Description of Artificial Sequence: chemically synthesized sequence
QGQSGSPCHPAPYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 116 - DNA, 534 bp, Artificial Sequence
  Description of Artificial Sequence: chemically synthesized sequence
caaggtcagtctggatccccgtgccatccgcatgcttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 117 - protein, 157 aa, Artificial Sequence
  Description of Artificial Sequence: chemically synthesized sequence
QGQSGSPCHPHAYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 118 - DNA, 534 bp, Artificial Sequence
  Description of Artificial Sequence: chemically synthesized sequence
caaggtcagtctggatccccgtgccatccgcatcctgctgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 119 - protein, 157 aa, Artificial Sequence
  Description of Artificial Sequence: chemically synthesized sequence
QGQSGSPCHPHPADARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 120 - DNA, 534 bp, Artificial Sequence
  Description of Artificial Sequence: chemically synthesized sequence
caaggtcagtctggatccccgtgccatccgcatccttatgctgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 121 - protein, 157 aa, Artificial Sequence
  Description of Artificial Sequence: chemically synthesized sequence
QGQSGSPCHPHPYAARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 122 - DNA, 534 bp, Artificial Sequence
  Description of Artificial Sequence: chemically synthesized sequence
caaggtcagtctggatccccgtgccatccgcatccttatgatgctgctccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 123 - protein, 157 aa, Artificial Sequence
  Description of Artificial Sequence: chemically synthesized sequence
QGQSGSPCHPHPYDAAPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 124 - DNA, 534 bp, Artificial Sequence
  Description of Artificial Sequence: chemically synthesized sequence
caaggtcagtctggatccccgtgccatccgcatccttatgatgctcgtcctgcttgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 125 - protein, 157 aa, Artificial Sequence
  Description of Artificial Sequence: chemically synthesized sequence
QGQSGSPCHPHPYDARPACNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 126 - DNA, 534 bp, Artificial Sequence
  Description of Artificial Sequence: chemically synthesized sequence
caaggtcagtctggatccccgtgccatccgcatccttatgatgctcgtccttattgcgctgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 127 - protein, 157 aa, Artificial Sequence
  Description of Artificial Sequence: chemically synthesized sequence
QGQSGSPCHPHPYDARPYCAVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 128 - DNA, 534 bp, Artificial Sequence
  Description of Artificial Sequence: chemically synthesized sequence
caaggtcagtctggatccccgtgccatgcgcatccttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 129 - protein, 157 aa, Artificial Sequence
  Description of Artificial Sequence: chemically synthesized sequence
QGQSGSPCHAHPYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 130 - DNA, 534 bp, Artificial Sequence
  Description of Artificial Sequence: chemically synthesized sequence
caaggtcagtctggatccccgtgccatccgcatccttatgatgctcgtgcttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 131 - protein, 157 aa, Artificial Sequence
  Description of Artificial Sequence: chemically synthesized sequence
QGQSGSPCHPHPYDARAYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 132 - DNA, 492 bp, Artificial Sequence
  Description of Artificial Sequence: chemically synthesized sequence
caaggtcagtctggatccggaggtggctcgagcggtggcagcggtggctctggtggtattagcagtggtctgttaagcggtcgtagcgataatcatggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 133 - protein, 158 aa, Artificial Sequence
  Description of Artificial Sequence: chemically synthesized sequence
QGQSGSLCEVLMLLQHPWCMGGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 134 - DNA, 492 bp, Artificial Sequence; identical to SEQ ID NO: 132
  Description of Artificial Sequence: chemically synthesized sequence

SEQ ID NO: 135 - protein, 158 aa, Artificial Sequence
  Description of Artificial Sequence: chemically synthesized sequence
QGQSGSILYCDSWGAGCLTRPGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 136 - DNA, 492 bp, Artificial Sequence; identical to SEQ ID NO: 132
  Description of Artificial Sequence: chemically synthesized sequence

SEQ ID NO: 137 - protein, 158 aa, Artificial Sequence
  Description of Artificial Sequence: chemically synthesized sequence
QGQSGSGIALCPSHFCQLPQTGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 138 - DNA, 492 bp, Artificial Sequence; identical to SEQ ID NO: 132
  Description of Artificial Sequence: chemically synthesized sequence

SEQ ID NO: 139 - protein, 158 aa, Artificial Sequence
  Description of Artificial Sequence: chemically synthesized sequence
QGQSGSPCHPHPYDARPYCNVGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 140 - DNA, 492 bp, Artificial Sequence; identical to SEQ ID NO: 132
  Description of Artificial Sequence: chemically synthesized sequence

SEQ ID NO: 141 - protein, 158 aa, Artificial Sequence
  Description of Artificial Sequence: chemically synthesized sequence
QGQSGSYLPCHFVPIGACNNKGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 142 - DNA, 492 bp, Artificial Sequence; identical to SEQ ID NO: 132
  Description of Artificial Sequence: chemically synthesized sequence

SEQ ID NO: 143 - protein, 158 aa, Artificial Sequence
  Description of Artificial Sequence: chemically synthesized sequence
QGQSGSIFCHMGVVVPQCANYGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 144 - DNA, 492 bp, Artificial Sequence; identical to SEQ ID NO: 132
  Description of Artificial Sequence: chemically synthesized sequence

SEQ ID NO: 145 - protein, 158 aa, Artificial Sequence
  Description of Artificial Sequence: chemically synthesized sequence
QGQSGSPCHPHAYDARPYCNVGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 146 - DNA, 495 bp, Artificial Sequence
  Description of Artificial Sequence: chemically synthesized sequence
caaggtcagtctggatccggaggtggctcgagcggtggcagcggtgctgtgggtctcctggctcccccgggcggcctgtccggccgcagcgataatcatggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 147 - protein, 159 aa, Artificial Sequence
  Description of Artificial Sequence: chemically synthesized sequence
QGQSGSLCEVLMLLQHPWCMGGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 148 - DNA, 495 bp, Artificial Sequence
  Description of Artificial Sequence: chemically synthesized sequence
caaggtcagtctggatccggaggtggctcgagcggtggcagcggtgctgtgggtctcctggctcccccgggcggcctgtccggccgcagcgataatcatggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgcgaagtcacccatcagggcctgagctcgcccgtcacaaagagcttcaacaggggagagtgt

SEQ ID NO: 149 - protein, 159 aa, Artificial Sequence
  Description of Artificial Sequence: chemically synthesized sequence
QGQSGSILYCDSWGAGCLTRPGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 150 - DNA, 495 bp, Artificial Sequence; identical to SEQ ID NO: 148
  Description of Artificial Sequence: chemically synthesized sequence

SEQ ID NO: 151 - protein, 159 aa, Artificial Sequence
  Description of Artificial Sequence: chemically synthesized sequence
QGQSGSGIALCPSHFCQLPQTGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 152 - DNA, 495 bp, Artificial Sequence; identical to SEQ ID NO: 148
  Description of Artificial Sequence: chemically synthesized sequence

SEQ ID NO: 153 - protein, 159 aa, Artificial Sequence
  Description of Artificial Sequence: chemically synthesized sequence
QGQSGSYLPCHFVPIGACNNKGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 154 - DNA, 495 bp, Artificial Sequence; identical to SEQ ID NO: 146
  Description of Artificial Sequence: chemically synthesized sequence

SEQ ID NO: 155 - protein, 159 aa, Artificial Sequence
  Description of Artificial Sequence: chemically synthesized sequence
QGQSGSIFCHMGVVVPQCANYGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 156 - DNA, 495 bp, Artificial Sequence; identical to SEQ ID NO: 146
  Description of Artificial Sequence: chemically synthesized sequence

SEQ ID NO: 157 - protein, 159 aa, Artificial Sequence
  Description of Artificial Sequence: chemically synthesized sequence
QGQSGSPCHPHAYDARPYCNVGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 158 - protein, 5 aa, Artificial Sequence
  Description of Artificial Sequence: chemically synthesized sequence
SYAMS

SEQ ID NO: 159 - protein, 11 aa, Artificial Sequence
  Description of Artificial Sequence: chemically synthesized sequence
AISGSGGSTYY

SEQ ID NO: 160 - protein, 11 aa, Artificial Sequence
  Description of Artificial Sequence: chemically synthesized sequence
SIYSTGGATAY

SEQ ID NO: 161 - protein, 11 aa, Artificial Sequence
  Description of Artificial Sequence: chemically synthesized sequence
  MOD_RES (1)..(1): Any naturally occurring amino acid
  MOD_RES (3)..(5): Any naturally occurring amino acid
  MOD_RES (7)..(8): Any naturally occurring amino acid
  MOD_RES (10)..(10): Any naturally occurring amino acid
XIXXXGGXTXY

SEQ ID NO: 162 - protein, 7 aa, Artificial Sequence
  Description of Artificial Sequence: chemically synthesized sequence
SSAGFDY

SEQ ID NO: 163 - protein, 7 aa, Artificial Sequence
  Description of Artificial Sequence: chemically synthesized sequence
  MOD_RES (1)..(2): Any naturally occurring amino acid
XXAGFDY

SEQ ID NO: 164 - protein, 7 aa, Artificial Sequence
  Description of Artificial Sequence: chemically synthesized sequence
  MOD_RES (2)..(3): Any naturally occurring amino acid
SXXGFDY

SEQ ID NO: 165 - protein, 7 aa, Artificial Sequence
  Description of Artificial Sequence: chemically synthesized sequence
  MOD_RES (3)..(4): Any naturally occurring amino acid
SSXXFDY

SEQ ID NO: 166 - protein, 7 aa, Artificial Sequence
  Description of Artificial Sequence: chemically synthesized sequence
  MOD_RES (1)..(1): Any naturally occurring amino acid
  MOD_RES (3)..(3): Any naturally occurring amino acid
XSXGFDY

SEQ ID NO: 167 - protein, 7 aa, Artificial Sequence
  Description of Artificial Sequence: chemically synthesized sequence
  MOD_RES (1)..(1): Any naturally occurring amino acid
  MOD_RES (4)..(4): Any naturally occurring amino acid
XSAXFDY

SEQ ID NO: 168 - protein, 7 aa, Artificial Sequence
  Description of Artificial Sequence: chemically synthesized sequence
  MOD_RES (2)..(2): Any naturally occurring amino acid
  MOD_RES (4)..(4): Any naturally occurring amino acid
SXAXFDY

SEQ ID NO: 169 - protein, 7 aa, Artificial Sequence
  Description of Artificial Sequence: chemically synthesized sequence
  MOD_RES (1)..(1): Any naturally occurring amino acid
  MOD_RES (5)..(5): Any naturally occurring amino acid
XSAGXDY

SEQ ID NO: 170 - protein, 7 aa, Artificial Sequence
  Description of Artificial Sequence: chemically synthesized sequence
  MOD_RES (2)..(2): Any naturally occurring amino acid
  MOD_RES (5)..(5): Any naturally occurring amino acid
SXAGXDY

SEQ ID NO: 171 - protein, 7 aa, Artificial Sequence
  Description of Artificial Sequence: chemically synthesized sequence
  MOD_RES (3)..(3): Any naturally occurring amino acid
  MOD_RES (5)..(5): Any naturally occurring amino acid
SSXGXDY

SEQ ID NO: 172 - protein, 7 aa, Artificial Sequence
  Description of Artificial Sequence: chemically synthesized sequence
  MOD_RES (4)..(5): Any naturally occurring amino acid
SSAXXDY

SEQ ID NO: 173 - protein, 6 aa, Artificial Sequence
  Description of Artificial Sequence: chemically synthesized sequence
  MOD_RES (2)..(5): Any naturally occurring amino acid
  MISC_FEATURE (2)..(5): This region may encompass 1-4 residues
TXXXXF

SEQ ID NO: 174 - protein, 6 aa, Artificial Sequence
  Description of Artificial Sequence: chemically synthesized sequence
QSISSY

SEQ ID NO: 175 - protein, 4 aa, Artificial Sequence
  Description of Artificial Sequence: chemically synthesized sequence
AASS

SEQ ID NO: 176 - protein, 4 aa, Artificial Sequence
  Description of Artificial Sequence: chemically synthesized sequence
YAST

SEQ ID NO: 177 - protein, 9 aa, Artificial Sequence
  Description of Artificial Sequence: chemically synthesized sequence
CQQSYSTPP

SEQ ID NO: 178 - protein, 10 aa, Artificial Sequence
  Description of Artificial Sequence: chemically synthesized sequence
CQQDNGYPST

SEQ ID NO: 179 - protein, 4 aa, Artificial Sequence
  Description of Artificial Sequence: chemically synthesized sequence
  MOD_RES (1)..(1): Any naturally occurring amino acid
  MOD_RES (4)..(4): Any naturally occurring amino acid
XASX

SEQ ID NO: 180 - protein, 7 aa, Artificial Sequence
  Description of Artificial Sequence: chemically synthesized sequence
  MOD_RES (1)..(2): Any naturally occurring amino acid
XXGYPST

SEQ ID NO: 181 - protein, 7 aa, Artificial Sequence
  Description of Artificial Sequence: chemically synthesized sequence
  MOD_RES (2)..(3): Any naturally occurring amino acid
DXXYPST

SEQ ID NO: 182 - protein, 7 aa, Artificial Sequence
  Description of Artificial Sequence: chemically synthesized sequence
  MOD_RES (3)..(4): Any naturally occurring amino acid
DNXXPST

SEQ ID NO: 183 - protein, 7 aa, Artificial Sequence
  Description of Artificial Sequence: chemically synthesized sequence
  MOD_RES (4)..(4): Any naturally occurring amino acid
  MOD_RES (6)..(6): Any naturally occurring amino acid
DNGXPXT

SEQ ID NO: 184 - protein, 7 aa, Artificial Sequence
  Description of Artificial Sequence: chemically synthesized sequence
  MOD_RES (6)..(7): Any naturally occurring amino acid
DNGYPXX

SEQ ID NO: 185 - protein, 7 aa, Artificial Sequence
  Description of Artificial Sequence: chemically synthesized sequence
  MOD_RES (1)..(1): Any naturally occurring amino acid
  MOD_RES (3)..(3): Any naturally occurring amino acid
XNXYPST

SEQ ID NO: 186 - protein, 7 aa, Artificial Sequence
  Description of Artificial Sequence: chemically synthesized sequence
  MOD_RES (1)..(1): Any naturally occurring amino acid
  MOD_RES (4)..(4): Any naturally occurring amino acid
XNGXPST

SEQ ID NO: 187 - protein, 7 aa, Artificial Sequence
  Description of Artificial Sequence: chemically synthesized sequence
  MOD_RES (1)..(1): Any naturally occurring amino acid
  MOD_RES (6)..(6): Any naturally occurring amino acid
XNGYPXT

SEQ ID NO: 188 - protein, 7 aa, Artificial Sequence
  Description of Artificial Sequence: chemically synthesized sequence
  MOD_RES (2)..(2): Any naturally occurring amino acid
  MOD_RES (4)..(4): Any naturally occurring amino acid
DXGXPST

SEQ ID NO: 189 - protein, 7 aa, Artificial Sequence
  Description of Artificial Sequence: chemically synthesized sequence
  MOD_RES (2)..(2): Any naturally occurring amino acid
  MOD_RES (6)..(6): Any naturally occurring amino acid
DXGYPXT

SEQ ID NO: 190 - protein, 7 aa, Artificial Sequence
  Description of Artificial Sequence: chemically synthesized sequence
  MOD_RES (3)..(3): Any naturally occurring amino acid
  MOD_RES (6)..(6): Any naturally occurring amino acid
DNXYPXT

SEQ ID NO: 191 - protein, 5 aa, Artificial Sequence
  Description of Artificial Sequence: chemically synthesized sequence
GSGGS

SEQ ID NO: 192 - protein, 4 aa, Artificial Sequence
  Description of Artificial Sequence: chemically synthesized sequence
GGGS

SEQ ID NO: 193 - protein, 4 aa, Artificial Sequence
  Description of Artificial Sequence: chemically synthesized sequence
GGSG

SEQ ID NO: 194 - protein, 5 aa, Artificial Sequence
  Description of Artificial Sequence: chemically synthesized sequence
GGSGG

SEQ ID NO: 195 - protein, 5 aa, Artificial Sequence
  Description of Artificial Sequence: chemically synthesized sequence
GSGSG

SEQ ID NO: 196 - protein, 5 aa, Artificial Sequence
  Description of Artificial Sequence: chemically synthesized sequence
GSGGG

SEQ ID NO: 197 - protein, 5 aa, Artificial Sequence
  Description of Artificial Sequence: chemically synthesized sequence
GGGSG

SEQ ID NO: 198 - protein, 5 aa, Artificial Sequence
  Description of Artificial Sequence: chemically synthesized sequence
GSSSG

SEQ ID NO: 199 - protein, 13 aa, Artificial Sequence
  Description of Artificial Sequence: chemically synthesized sequence
GSSGGSGGSGGSG

SEQ ID NO: 200 - protein, 11 aa, Artificial Sequence
  Description of Artificial Sequence: chemically synthesized sequence
GSSGGSGGSGG

SEQ ID NO: 201 - protein, 12 aa, Artificial Sequence
  Description of Artificial Sequence: chemically synthesized sequence
GSSGGSGGSGGS

SEQ ID NO: 202 - protein, 16 aa, Artificial Sequence
  Description of Artificial Sequence: chemically synthesized sequence
GSSGGSGGSGGSGGGS

SEQ ID NO: 203 - protein, 10 aa, Artificial Sequence
  Description of Artificial Sequence: chemically synthesized sequence
GSSGGSGGSG

SEQ ID NO: 204 - protein, 11 aa, Artificial Sequence
  Description of Artificial Sequence: chemically synthesized sequence
GSSGGSGGSGS

SEQ ID NO: 205 - protein, 4 aa, Artificial Sequence
  Description of Artificial Sequence: chemically synthesized sequence
GGGS

SEQ ID NO: 206 - protein, 5 aa, Artificial Sequence
  Description of Artificial Sequence: chemically synthesized sequence
GSSGT

SEQ ID NO: 207 - protein, 4 aa, Artificial Sequence
  Description of Artificial Sequence: chemically synthesized sequence
GSSG

SEQ ID NO: 208 - protein, 15 aa, Artificial Sequence
  Description of Artificial Sequence: chemically synthesized sequence
YCEVSELFVLPWCMG

SEQ ID NO: 209 - protein, 11 aa, Artificial Sequence
  Description of Artificial Sequence: chemically synthesized sequence
RASQSISSYLN

SEQ ID NO: 210 - protein, 7 aa, Artificial Sequence
  Description of Artificial Sequence: chemically synthesized sequence
KASRLQS

SEQ ID NO: 211 - protein, 7 aa, Artificial Sequence
  Description of Artificial Sequence: chemically synthesized sequence
RALKPVT

SEQ ID NO: 212 - protein, 5 aa, Artificial Sequence
  Description of Artificial Sequence: chemically synthesized sequence
SYAMS

SEQ ID NO: 213 - protein, 14 aa, Artificial Sequence
  Description of Artificial Sequence: chemically synthesized sequence
DITASGQRTTYADS

SEQ ID NO: 214 - protein, 7 aa, Artificial Sequence
  Description of Artificial Sequence: chemically synthesized sequence
SKAIFDY

SEQ ID NO: 215 - protein, 7 aa, Artificial Sequence
  Description of Artificial Sequence: chemically synthesized sequence
AASSLQS

SEQ ID NO: 216 - protein, 7 aa, Artificial Sequence
  Description of Artificial Sequence: chemically synthesized sequence
SYSTPNT

SEQ ID NO: 217 - protein, 14 aa, Artificial Sequence
  Description of Artificial Sequence: chemically synthesized sequence
SINKDGHYTSYADS

SEQ ID NO: 218 - protein, 7 aa, Artificial Sequence
  Description of Artificial Sequence: chemically synthesized sequence
NLDEFDY

SEQ ID NO: 219 - protein, 7 aa, Artificial Sequence
  Description of Artificial Sequence: chemically synthesized sequence
SASQLQS

SEQ ID NO: 220 - protein, 7 aa, Artificial Sequence
  Description of Artificial Sequence: chemically synthesized sequence
ANSRPST

SEQ ID NO: 221 - protein, 14 aa, Artificial Sequence
  Description of Artificial Sequence: chemically synthesized sequence
SIMATGAGTLYADS

SEQ ID NO: 222 - protein, 7 aa, Artificial Sequence
  Description of Artificial Sequence: chemically synthesized sequence
DGAGFDY

SEQ ID NO: 223 - protein, 7 aa, Artificial Sequence
  Description of Artificial Sequence: chemically synthesized sequence
NASSLQS

SEQ ID NO: 224 - protein, 6 aa, Artificial Sequence
  Description of Artificial Sequence: chemically synthesized sequence
YPYGPG

SEQ ID NO: 225 - protein, 14 aa, Artificial Sequence
  Description of Artificial Sequence: chemically synthesized sequence
TITSSGAATYYADS

SEQ ID NO: 226 - protein, 7 aa, Artificial Sequence
  Description of Artificial Sequence: chemically synthesized sequence
NYTGFDY

SEQ ID NO: 227 - protein, 7 aa, Artificial Sequence
  Description of Artificial Sequence: chemically synthesized sequence
YASTLQS

SEQ ID NO: 228 - protein, 7 aa, Artificial Sequence
  Description of Artificial Sequence: chemically synthesized sequence
DNGYPST

SEQ ID NO: 229 - protein, 14 aa, Artificial Sequence
  Description of Artificial Sequence: chemically synthesized sequence
SIYSTGGATAYADS

SEQ ID NO: 230 - protein, 7 aa, Artificial Sequence
  Description of Artificial Sequence: chemically synthesized sequence
SSAGFDY

SEQ ID NO: 231 - protein, 15 aa, Artificial Sequence
  Description of Artificial Sequence: chemically synthesized sequence
SSIYSTGGATAYADS

SEQ ID NO: 232 - protein, 12 aa, Artificial Sequence
  Description of Artificial Sequence: chemically synthesized sequence
SSAGQSRPGFDY

SEQ ID NO: 233 - protein, 12 aa, Artificial Sequence
  Description of Artificial Sequence: chemically synthesized sequence
SSAGQSWPGFDY

SEQ ID NO: 234 - protein, 12 aa, Artificial Sequence
  Description of Artificial Sequence: chemically synthesized sequence
SSAGQSFPGFDY

SEQ ID NO: 235 - protein, 7 aa, Artificial Sequence
  Description of Artificial Sequence: chemically synthesized sequence
WSAAFDY

SEQ ID NO: 236 - protein, 7 aa, Artificial Sequence
  Description of Artificial Sequence: chemically synthesized sequence
WSAGYDY

SEQ ID NO: 237 - protein, 7 aa, Artificial Sequence
  Description of Artificial Sequence: chemically synthesized sequence
WSKGFDY

SEQ ID NO: 238 - protein, 14 aa, Artificial Sequence
  Description of Artificial Sequence: chemically synthesized sequence
SSIWKQGIVTVYDS

SEQ ID NO: 239 - protein, 14 aa, Artificial Sequence
  Description of Artificial Sequence: chemically synthesized sequence
SSIWRNGIVTVYDS

SEQ ID NO: 240 - protein, 14 aa, Artificial Sequence
  Description of Artificial Sequence: chemically synthesized sequence
SDIWKQGMVTVYDS

SEQ ID NO: 241 - protein, 14 aa, Artificial Sequence
  Description of Artificial Sequence: chemically synthesized sequence
SSIWRQGLATAYDS

SEQ ID NO: 242 - protein, 14 aa, Artificial Sequence
  Description of Artificial Sequence: chemically synthesized sequence
SEIVATGILTSYDS

SEQ ID NO: 243 - protein, 14 aa, Artificial Sequence
  Description of Artificial Sequence: chemically synthesized sequence
SSIGRQGLITVYDS

SEQ ID NO: 244 - protein, 14 aa, Artificial Sequence
  Description of Artificial Sequence: chemically synthesized sequence
SSIWYQGLVTVYDS

SEQ ID NO: 245 - protein, 13 aa, Artificial Sequence
  Description of Artificial Sequence: chemically synthesized sequence
SDIWKQGFATADS

SEQ ID NO: 246 - protein, 15 aa, Artificial Sequence
  Description of Artificial Sequence: chemically synthesized sequence
SSIWRNGIVTVYADS

SEQ ID NO: 247 - protein, 15 aa, Artificial Sequence
  Description of Artificial Sequence: chemically synthesized sequence
SSIWYQGLVTVYADS

SEQ ID NO: 248 - protein, 117 aa, Artificial Sequence
  Description of Artificial Sequence: chemically synthesized sequence
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 249 - protein, 123 aa, Artificial Sequence
  Description of Artificial Sequence: chemically synthesized sequence
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 250 - protein, 112 aa, Artificial Sequence
  Description of Artificial Sequence: chemically synthesized sequence
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGT

SEQ ID NO: 251 - protein, 120 aa, Artificial Sequence
  Description of Artificial Sequence: chemically synthesized sequence
QVQLVQSGAEVKKPGSSVKVSCKVSGGIFSTYAINWVRQAPGQGLEWMGGIIPIFGTANHAQKFQGRVTITADESTSTAYMELSSLRSEDTAVYYCARDQGIAAALFDYWGQGTLVTVSS

SEQ ID NO: 252 - protein, 110 aa, Artificial Sequence
  Description of Artificial Sequence: chemically synthesized sequence
EVQLVESGGGLVQPGRSLRLSCAVSGFTFDDYVVHWVRQAPGKGLEWVSGNSGNIGYADSVKGRFTISRDNAKNSLYLQMNSLRAEDTALYYCAVPFDYWGQGTLVTVSS

SEQ ID NO: 253 - protein, 123 aa, Artificial Sequence
  Description of Artificial Sequence: chemically synthesized sequence
QVQLVQSGAEVKKPGSSVKVSCKTSGDTFSSYAISWVRQAPGQGLEWMGGIIPIFGRAHYAQKFQGRVTITADESTSTAYMELSSLRSEDTAVYFCARKFHFVSGSPFGMDVWGQGTTVTVSS

SEQ ID NO: 254 - protein, 123 aa, Artificial Sequence
  Description of Artificial Sequence: chemically synthesized sequence
QVQLVQSGAEVKKPGSSVKVSCKTSGGTFSSYAISWVRQAPGQGLEWMGGIIPIFGKAHYAQKFQGRVTITADESTTTAYMELSSLRSEDTAVYYCARKYDYVSGSPFGMDVWGQGTTVTVSS

SEQ ID NO: 255 - protein, 121 aa, Artificial Sequence
  Description of Artificial Sequence: chemically synthesized sequence
QVQLVQSGAEVKKPGSSVKVSCKASGGTFSSYAINWVRQAPGQGLEWMGGIIPIFGSANYAQKFQDRVTITADESTSAAYMELSSLRSEDTAVYYCARDSSGWSRYYMDVWGQGTTVTVSS

SEQ ID NO: 256 - protein, 123 aa, Artificial Sequence
  Description of Artificial Sequence: chemically synthesized sequence
QVQLVQSGAEVKEPGSSVKVSCKASGGTFNSYAISWVRQAPGQGLEWMGGIIPLFGIAHYAQKFQGRVTITADESTNTAYMDLSSLRSEDTAVYYCARKYSYVSGSPFGMDVWGQGTTVTVSS

SEQ ID NO: 257 - protein, 121 aa, Artificial Sequence
  Description of Artificial Sequence: chemically synthesized sequence
EVQLVESGGGLVQPGRSLRLSCAASGITFDDYGMHWVRQAPGKGLEWVSGISWNRGRIEYADSVKGRFTISRDNAKNSLYLQMNSLRAEDTALYYCAKGRFRYFDWFLDYWGQGTLVTVSS

SEQ ID NO: 258 - protein, 107 aa, Artificial Sequence
  Description of Artificial Sequence: chemically synthesized sequence
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 259 - protein, 106 aa, Artificial Sequence
  Description of Artificial Sequence: chemically synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 260 - protein, 107 aa, Artificial Sequence
  Description of Artificial Sequence: chemically synthesized sequence
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 261 - protein, 108 aa, Artificial Sequence
  Description of Artificial Sequence: chemically synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 262 - protein, 106 aa, Artificial Sequence
  Description of Artificial Sequence: chemically synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFGGGTKVEIK

SEQ ID NO: 263 - protein, 106 aa, Artificial Sequence
  Description of Artificial Sequence: chemically synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTRLEIK

SEQ ID NO: 264 - protein, 107 aa, Artificial Sequence
  Description of Artificial Sequence: chemically synthesized sequence
AIQLTQSPSSLSASVGDRVTITCRASQGISSALAWYQQKPGKAPKLLIYDASSLESGVPSRFSGSGSGTDFTLTISSLQPEDFATYYCQQFNSYPFTFGPGTKVDIK

SEQ ID NO: 265 - protein, 121 aa, Artificial Sequence
  Description of Artificial Sequence: chemically synthesized sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 266 - protein, 108 aa, Artificial Sequence
  Description of Artificial Sequence: chemically synthesized sequence
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 267 - protein, 118 aa, Artificial Sequence
  Description of Artificial Sequence: chemically synthesized sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 268 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 269 - protein, 8 aa, Artificial Sequence
  Description of Artificial Sequence: chemically synthesized sequence
DYFYGMDV

SEQ ID NO: 270 - protein, 14 aa, Artificial Sequence
  Description of Artificial Sequence: chemically synthesized sequence
KFHFVSGSPFGMDV

SEQ ID NO: 271 - protein, 9 aa, Artificial Sequence
  Description of Artificial Sequence: chemically synthesized sequence
ERIQLWFDY

SEQ ID NO: 272 - protein, 11 aa, Artificial Sequence
  Description of Artificial Sequence: chemically synthesized sequence
DQGIAAALFDY

SEQ ID NO: 273 - protein, 4 aa, Artificial Sequence
  Description of Artificial Sequence: chemically synthesized sequence
PFDY

SEQ ID NO: 274 - protein, 14 aa, Artificial Sequence
  Description of Artificial Sequence: chemically synthesized sequence
KYDYVSGSPFGMDV

SEQ ID NO: 275 - protein, 12 aa, Artificial Sequence
  Description of Artificial Sequence: chemically synthesized sequence
DSSGWSRYYMDV

SEQ ID NO: 276 - protein, 14 aa, Artificial Sequence
  Description of Artificial Sequence: chemically synthesized sequence
KYSYVSGSPFGMDV

SEQ ID NO: 277 - protein, 12 aa, Artificial Sequence
  Description of Artificial Sequence: chemically synthesized sequence
GRFRYFDWFLDY

SEQ ID NO: 278 - protein, 9 aa, Artificial Sequence
  Description of Artificial Sequence: chemically synthesized sequence
QQRSNWPRT

SEQ ID NO: 279 - protein, 8 aa, Artificial Sequence
  Description of Artificial Sequence: chemically synthesized sequence
QQRSNWPT

SEQ ID NO: 280 - protein, 9 aa, Artificial Sequence
  Description of Artificial Sequence: chemically synthesized sequence
QQYNSYPYT

SEQ ID NO: 281 - protein, 9 aa, Artificial Sequence
  Description of Artificial Sequence: chemically synthesized sequence
QQYGSSPWT

SEQ ID NO: 282 - protein, 7 aa, Artificial Sequence
  Description of Artificial Sequence: chemically synthesized sequence
QQYGSSP

SEQ ID NO: 283 - protein, 9 aa, Artificial Sequence
  Description of Artificial Sequence: chemically synthesized sequence
QQFNSYPFT

SEQ ID NO: 284 - protein, 17 aa, Artificial Sequence
  Description of Artificial Sequence: chemically synthesized sequence
WITAYNGNTNYAQKLQG

SEQ ID NO: 285 - protein, 17 aa, Artificial Sequence
  Description of Artificial Sequence: chemically synthesized sequence
GIIPIFGKAHYAQKFQG

SEQ ID NO: 286 - protein, 17 aa, Artificial Sequence
  Description of Artificial Sequence: chemically synthesized sequence
WLHADTGITKFSQKFQG

SEQ ID NO: 287 - protein, 17 aa, Artificial Sequence
  Description of Artificial Sequence: chemically synthesized sequence
GIIPIFGTANHAQKFQG

SEQ ID NO: 288 - protein, 17 aa, Artificial Sequence
  Description of Artificial Sequence: chemically synthesized sequence
GISGNSGNIGYADSVKG

SEQ ID NO: 289 - protein, 17 aa, Artificial Sequence
  Description of Artificial Sequence: chemically synthesized sequence
GIIPIFGRAHYAQKFQG

SEQ ID NO: 290 - protein, 17 aa, Artificial Sequence
  Description of Artificial Sequence: chemically synthesized sequence
GIIPIFGSANYAQKFQD

SEQ ID NO: 291 - protein, 17 aa, Artificial Sequence
  Description of Artificial Sequence: chemically synthesized sequence
GIIPLFGIAHYAQKFQG

SEQ ID NO: 292 - protein, 17 aa, Artificial Sequence
  Description of Artificial Sequence: chemically synthesized sequence
GISWNRGRIEYADSVKG

SEQ ID NO: 293 - protein, 7 aa, Artificial Sequence
  Description of Artificial Sequence: chemically synthesized sequence
DASNRAT

SEQ ID NO: 294 - protein, 7 aa, Artificial Sequence
  Description of Artificial Sequence: chemically synthesized sequence
GASSRAT

SEQ ID NO: 295 - protein, 7 aa, Artificial Sequence
  Description of Artificial Sequence: chemically synthesized sequence
DASSLES

SEQ ID NO: 296 - protein, 5 aa, Artificial Sequence
  Description of Artificial Sequence: chemically synthesized sequence
DYGFS

SEQ ID NO: 297 - protein, 5 aa, Artificial Sequence
  Description of Artificial Sequence: chemically synthesized sequence
TYAIS

SEQ ID NO: 298 - protein, 5 aa, Artificial Sequence
  Description of Artificial Sequence: chemically synthesized sequence
SYDVH

SEQ ID NO: 299 - protein, 5 aa, Artificial Sequence
  Description of Artificial Sequence: chemically synthesized sequence
TYAIN

SEQ ID NO: 300 - protein, 5 aa, Artificial Sequence
  Description of Artificial Sequence: chemically synthesized sequence
DYVVH

SEQ ID NO: 301 - protein, 5 aa, Artificial Sequence
  Description of Artificial Sequence: chemically synthesized sequence
SYAIS

SEQ ID NO: 302 - protein, 5 aa, Artificial Sequence
  Description of Artificial Sequence: chemically synthesized sequence
SYAIN

SEQ ID NO: 303 - protein, 5 aa, Artificial Sequence
  Description of Artificial Sequence: chemically synthesized sequence
DYGMH

SEQ ID NO: 304 - protein, 11 aa, Artificial Sequence
  Description of Artificial Sequence: chemically synthesized sequence
RASQSVSSYLV

SEQ ID NO: 305 - protein, 11 aa, Artificial Sequence
  Description of Artificial Sequence: chemically synthesized sequence
RASQSVSSYLA

SEQ ID NO: 306 - protein, 11 aa, Artificial Sequence
  Description of Artificial Sequence: chemically synthesized sequence
RASQGISSWLA

SEQ ID NO: 307 - protein, 12 aa, Artificial Sequence
  Description of Artificial Sequence: chemically synthesized sequence
RASQSVSSSYLA

SEQ ID NO: 308 - protein, 11 aa, Artificial Sequence
  Description of Artificial Sequence: chemically synthesized sequence
RASQGISSALA

SEQ ID NO: 309 - protein, 5 aa, Artificial Sequence
  Description of Artificial Sequence: chemically synthesized sequence
TYSMN

SEQ ID NO: 310 - protein, 16 aa, Artificial Sequence
  Description of Artificial Sequence: chemically synthesized sequence
SISSSGDYIYYADSVK

SEQ ID NO: 311 - protein, 11 aa, Artificial Sequence
  Description of Artificial Sequence: chemically synthesized sequence
DLVTSMVAFDY

SEQ ID NO: 312 - protein, 11 aa, Artificial Sequence
  Description of Artificial Sequence: chemically synthesized sequence
SGDALPQKYVF

SEQ ID NO: 313 - protein, 7 aa, Artificial Sequence
  Description of Artificial Sequence: chemically synthesized sequence
EDSKRPS

SEQ ID NO: 314 - protein, 11 aa, Artificial Sequence
  Description of Artificial Sequence: chemically synthesized sequence
YSTDRSGNHRV

SEQ ID NO: 315 - protein, 5 aa, Artificial Sequence
  Description of Artificial Sequence: chemically synthesized sequence
RYWMS

SEQ ID NO: 316 - protein, 17 aa, Artificial Sequence
  Description of Artificial Sequence: chemically synthesized sequence
NIKQDGSEKYYVDSVKG

SEQ ID NO: 317 - protein, 12 aa, Artificial Sequence
  Description of Artificial Sequence: chemically synthesized sequence
EGGWFGELAFDY

SEQ ID NO: 318 - protein, 12 aa, Artificial Sequence
  Description of Artificial Sequence: chemically synthesized sequence
RASQRVSSSYLA

SEQ ID NO: 319 - protein, 7 aa, Artificial Sequence
  Description of Artificial Sequence: chemically synthesized sequence
DASSRAT

SEQ ID NO: 320 - protein, 9 aa, Artificial Sequence
  Description of Artificial Sequence: chemically synthesized sequence
QQYGSLPWT

SEQ ID NO: 321 - protein, 5 aa, Artificial Sequence
  Description of Artificial Sequence: chemically synthesized sequence
SYWMS

SEQ ID NO: 322 - protein, 16 aa, Artificial Sequence
  Description of Artificial Sequence: chemically synthesized sequence
NIKQDGGEQYYVDSVK

SEQ ID NO: 323 - protein, 11 aa, Artificial Sequence
  Description of Artificial Sequence: chemically synthesized sequence
DWNYGYYDMDV

SEQ ID NO: 324 - protein, 12 aa, Artificial Sequence
  Description of Artificial Sequence: chemically synthesized sequence
RASQSVSSNYLA

SEQ ID NO: 325 - protein, 7 aa, Artificial Sequence
  Description of Artificial Sequence: chemically synthesized sequence
GTSSRAT

SEQ ID NO: 326 - protein, 9 aa, Artificial Sequence
  Description of Artificial Sequence: chemically synthesized sequence
QQYGSSIFT

SEQ ID NO: 327 - protein, 11 aa, Artificial Sequence
  Description of Artificial Sequence: chemically synthesized sequence
  MOD_RES (5)..(5): Asp or Val
  MOD_RES (6)..(6): Val or Ile
  MOD_RES (7)..(7): Ser or Asn
  MOD_RES (9)..(9): Ala or Phe
  MOD_RES (10)..(10): Val or Leu
RASQXXXTXXA

SEQ ID NO: 328 - protein, 7 aa, Artificial Sequence
  Description of Artificial Sequence: chemically synthesized sequence
  MOD_RES (4)..(4): Phe or Thr
  MOD_RES (6)..(6): Tyr or Ala
SASXLXS

SEQ ID NO: 329 - protein, 9 aa, Artificial Sequence
  Description of Artificial Sequence: chemically synthesized sequence
  MOD_RES (3)..(3): Tyr, Gly, Phe or Ser
  MOD_RES (4)..(4): Leu, Tyr, Phe or Trp
  MOD_RES (5)..(5): Tyr, Asn, Ala, Thr, Gly, Phe or Ile
  MOD_RES (6)..(6): His, Val, Pro, Thr or Ile
  MOD_RES (8)..(8): Ala, Trp, Arg, Pro or Thr
QQXXXXPXT

SEQ ID NO: 330 - protein, 10 aa, Artificial Sequence
  Description of Artificial Sequence: chemically synthesized sequence
  MOD_RES (6)..(6): Asp or Gly
GFTFSXSWIH

SEQ ID NO: 331 - protein, 18 aa, Artificial Sequence
  Description of Artificial Sequence: chemically synthesized sequence
  MOD_RES (4)..(4): Ser or Leu
  MOD_RES (10)..(10): Thr or Ser
AWIXPYGGSXYYADSVKG

SEQ ID NO: 332 - protein, 9 aa, Artificial Sequence
  Description of Artificial Sequence: chemically synthesized sequence
RHWPGGFDY

SEQ ID NO: 333 - protein, 11 aa, Artificial Sequence
  Description of Artificial Sequence: chemically synthesized sequence
RASQDVSTAVA

SEQ ID NO: 334 - protein, 7 aa, Artificial Sequence
  Description of Artificial Sequence: chemically synthesized sequence
SASFLYS

SEQ ID NO: 335 - protein, 9 aa, Artificial Sequence
  Description of Artificial Sequence: chemically synthesized sequence
QQYLYHPAT

SEQ ID NO: 336 - protein, 10 aa, Artificial Sequence
  Description of Artificial Sequence: chemically synthesized sequence
GFTFSDSWIH

SEQ ID NO: 337 - protein, 18 aa, Artificial Sequence
  Description of Artificial Sequence: chemically synthesized sequence
AWISPYGGSTYYADSVKG

SEQ ID NO: 338 - protein, 8 aa, Artificial Sequence
  Description of Artificial Sequence: chemically synthesized sequence
TGRGPSWV

SEQ ID NO: 339 - protein, 8 aa, Artificial Sequence
  Description of Artificial Sequence: chemically synthesized sequence
SARGPSRW

SEQ ID NO: 340 - protein, 8 aa, Artificial Sequence
  Description of Artificial Sequence: chemically synthesized sequence
TARGPSFK

SEQ ID NO: 341 - protein, 8 aa, Artificial Sequence
  Description of Artificial Sequence: chemically synthesized sequence
LSGRSDNH

SEQ ID NO: 342 - protein, 8 aa, Artificial Sequence
  Description of Artificial Sequence: chemically synthesized sequence
GGWHTGRN

SEQ ID NO: 343 - protein, 8 aa, Artificial Sequence
  Description of Artificial Sequence: chemically synthesized sequence
HTGRSGAL

SEQ ID NO: 344 - protein, 8 aa, Artificial Sequence
  Description of Artificial Sequence: chemically synthesized sequence
PLTGRSGG

SEQ ID NO: 345 - protein, 8 aa, Artificial Sequence
  Description of Artificial Sequence: chemically synthesized sequence
AARGPAIH

SEQ ID NO: 346 - protein, 8 aa, Artificial Sequence
  Description of Artificial Sequence: chemically synthesized sequence
RGPAFNPM

SEQ ID NO: 347 - protein, 8 aa, Artificial Sequence
  Description of Artificial Sequence: chemically synthesized sequence
SSRGPAYL

SEQ ID NO: 348 - protein, 8 aa, Artificial Sequence
  Description of Artificial Sequence: chemically synthesized sequence
RGPATPIM

SEQ ID NO: 349 - protein, 4 aa, Artificial Sequence
  Description of Artificial Sequence: chemically synthesized sequence
RGPA

SEQ ID NO: 350 - protein, 10 aa, Artificial Sequence
  Description of Artificial Sequence: chemically synthesized sequence
GGQPSGMWGW

SEQ ID NO: 351 - protein, 10 aa, Artificial Sequence
  Description of Artificial Sequence: chemically synthesized sequence
FPRPLGITGL

SEQ ID NO: 352 - protein, 10 aa, Artificial Sequence
  Description of Artificial Sequence: chemically synthesized sequence
VHMPLGFLGP

SEQ ID NO: 353 - protein, 8 aa, Artificial Sequence
  Description of Artificial Sequence: chemically synthesized sequence
SPLTGRSG

SEQ ID NO: 354 - protein, 8 aa, Artificial Sequence
  Description of Artificial Sequence: chemically synthesized sequence
SAGFSLPA

SEQ ID NO: 355 - protein, 9 aa, Artificial Sequence
  Description of Artificial Sequence: chemically synthesized sequence
LAPLGLQRR

SEQ ID NO: 356 - protein, 8 aa, Artificial Sequence
  Description of Artificial Sequence: chemically synthesized sequence
SGGPLGVR

SEQ ID NO: 357 - protein, 4 aa, Artificial Sequence
  Description of Artificial Sequence: chemically synthesized sequence
PLGL

SEQ ID NO: 358 - protein, 7 aa, Artificial Sequence
  Description of Artificial Sequence: chemically synthesized sequence
ISSGLSS

SEQ ID NO: 359 - protein, 8 aa, Artificial Sequence
  Description of Artificial Sequence: chemically synthesized sequence
QNQALRMA

SEQ ID NO: 360 - protein, 8 aa, Artificial Sequence
  Description of Artificial Sequence: chemically synthesized sequence
AQNLLGMV

SEQ ID NO: 361 - protein, 8 aa, Artificial Sequence
  Description of Artificial Sequence: chemically synthesized sequence
STFPFGMF

SEQ ID NO: 362 - protein, 8 aa, Artificial Sequence
  Description of Artificial Sequence: chemically synthesized sequence
PVGYTSSL

SEQ ID NO: 363 - protein, 8 aa, Artificial Sequence
  Description of Artificial Sequence: chemically synthesized sequence
DWLYWPGI

SEQ ID NO: 364 - protein, 8 aa, Artificial Sequence
  Description of Artificial Sequence: chemically synthesized sequence
ISSGLLSS

SEQ ID NO: 365 - protein, 8 aa, Artificial Sequence
  Description of Artificial Sequence: chemically synthesized sequence
LKAAPRWA

SEQ ID NO: 366 - protein, 8 aa, Artificial Sequence
  Description of Artificial Sequence: chemically synthesized sequence
GPSHLVLT

SEQ ID NO: 367 - protein, 8 aa, Artificial Sequence
  Description of Artificial Sequence: chemically synthesized sequence
LPGGLSPW

SEQ ID NO: 368 - protein, 8 aa, Artificial Sequence
  Description of Artificial Sequence: chemically synthesized sequence
MGLFSEAG

SEQ ID NO: 369 - protein, 8 aa, Artificial Sequence
  Description of Artificial Sequence: chemically synthesized sequence
SPLPLRVP

SEQ ID NO: 370 - protein, 8 aa, Artificial Sequence
  Description of Artificial Sequence: chemically synthesized sequence
RMHLRSLG

SEQ ID NO: 371 - protein, 8 aa, Artificial Sequence
  Description of Artificial Sequence: chemically synthesized sequence
LAAPLGLL

SEQ ID NO: 372 - protein, 8 aa, Artificial Sequence
  Description of Artificial Sequence: chemically synthesized sequence
AVGLLAPP

SEQ ID NO: 373 - protein, 8 aa, Artificial Sequence
  Description of Artificial Sequence: chemically synthesized sequence
LLAPSHRA

SEQ ID NO: 374 - protein, 8 aa, Artificial Sequence
  Description of Artificial Sequence: chemically synthesized sequence
PAGLWLDP

SEQ ID NO: 375 - protein, 7 aa, Artificial Sequence
  Description of Artificial Sequence: chemically synthesized sequence
GPRSFGL

SEQ ID NO: 376 - protein, 6 aa, Artificial Sequence
  Description of Artificial Sequence: chemically synthesized sequence
GPRSFG

SEQ ID NO: 377 - protein, 13 aa, Artificial Sequence
  Description of Artificial Sequence: chemically synthesized sequence
ISSGLLSGRSDNH

SEQ ID NO: 378 - protein, 22 aa, Artificial Sequence
  Description of Artificial Sequence: chemically synthesized sequence
ISSGLLSSGGSGGSLSGRSDNH

SEQ ID NO: 379 - protein, 22 aa, Artificial Sequence
  Description of Artificial Sequence: chemically synthesized sequence
AVGLLAPPGGTSTSGRSANPRG

SEQ ID NO: 380 - protein, 22 aa, Artificial Sequence
  Description of Artificial Sequence: chemically synthesized sequence
TSTSGRSANPRGGGAVGLLAPP

SEQ ID NO: 381 - protein, 24 aa, Artificial Sequence
  Description of Artificial Sequence: chemically synthesized sequence
VHMPLGFLGPGGTSTSGRSANPRG

SEQ ID NO: 382 - protein, 24 aa, Artificial Sequence
  Description of Artificial Sequence: chemically synthesized sequence
TSTSGRSANPRGGGVHMPLGFLGP

SEQ ID NO: 383 - protein, 18 aa, Artificial Sequence
  Description of Artificial Sequence: chemically synthesized sequence
AVGLLAPPGGLSGRSDNH

SEQ ID NO: 384 - protein, 18 aa, Artificial Sequence
  Description of Artificial Sequence: chemically synthesized sequence
LSGRSDNHGGAVGLLAPP

SEQ ID NO: 385 - protein, 20 aa, Artificial Sequence
  Description of Artificial Sequence: chemically synthesized sequence
VHMPLGFLGPGGLSGRSDNH

SEQ ID NO: 386 - protein, 20 aa, Artificial Sequence
  Description of Artificial Sequence: chemically synthesized sequence
LSGRSDNHGGVHMPLGFLGP

SEQ ID NO: 387 - protein, 22 aa, Artificial Sequence
  Description of Artificial Sequence: chemically synthesized sequence
LSGRSDNHGGSGGSISSGLLSS

SEQ ID NO: 388 - protein, 22 aa, Artificial Sequence
  Description of Artificial Sequence: chemically synthesized sequence
LSGRSGNHGGSGGSISSGLLSS

SEQ ID NO: 389 - protein, 22 aa, Artificial Sequence
  Description of Artificial Sequence: chemically synthesized sequence
ISSGLLSSGGSGGSLSGRSGNH

SEQ ID NO: 390 - protein, 22 aa, Artificial Sequence
  Description of Artificial Sequence: chemically synthesized sequence
LSGRSDNHGGSGGSQNQALRMA

SEQ ID NO: 391 - protein, 22 aa, Artificial Sequence
  Description of Artificial Sequence: chemically synthesized sequence
QNQALRMAGGSGGSLSGRSDNH

SEQ ID NO: 392 - protein, 22 aa, Artificial Sequence
  Description of Artificial Sequence: chemically synthesized sequence
LSGRSGNHGGSGGSQNQALRMA

SEQ ID NO: 393 - protein, 22 aa, Artificial Sequence
  Description of Artificial Sequence: chemically synthesized sequence
QNQALRMAGGSGGSLSGRSGNH

SEQ ID NO: 394 - protein, 13 aa, Artificial Sequence
  Description of Artificial Sequence: chemically synthesized sequence
ISSGLLSGRSGNH

SEQ ID NO: 395 - protein, 6 aa, Artificial Sequence
  Description of Artificial Sequence: chemically synthesized sequence
GQSGQG

SEQ ID NO: 396 - protein, 8 aa, Artificial Sequence
  Description of Artificial Sequence: chemically synthesized sequence
PRFKIIGG

SEQ ID NO: 397 - protein, 8 aa, Artificial Sequence
  Description of Artificial Sequence: chemically synthesized sequence
PRFRIIGG

SEQ ID NO: 398 - protein, 9 aa, Artificial Sequence
  Description of Artificial Sequence: chemically synthesized sequence
SSRHRRALD

SEQ ID NO: 399 - protein, 14 aa, Artificial Sequence
  Description of Artificial Sequence: chemically synthesized sequence
RKSSIIIRMRDVVL

SEQ ID NO: 400 - protein, 15 aa, Artificial Sequence
  Description of Artificial Sequence: chemically synthesized sequence
SSSFDKGKYKKGDDA

SEQ ID NO: 401 - protein, 15 aa, Artificial Sequence
  Description of Artificial Sequence: chemically synthesized sequence
SSSFDKGKYKRGDDA

SEQ ID NO: 402 - protein, 4 aa, Artificial Sequence
  Description of Artificial Sequence: chemically synthesized sequence
IEGR

SEQ ID NO: 403 - protein, 4 aa, Artificial Sequence
  Description of Artificial Sequence: chemically synthesized sequence
IDGR

SEQ ID NO: 404 - protein, 7 aa, Artificial Sequence
  Description of Artificial Sequence: chemically synthesized sequence
GGSIDGR

SEQ ID NO: 405 - protein, 6 aa, Artificial Sequence
  Description of Artificial Sequence: chemically synthesized sequence
PLGLWA

SEQ ID NO: 406 - protein, 8 aa, Artificial Sequence
  Description of Artificial Sequence: chemically synthesized sequence
GPQGIAGQ

SEQ ID NO: 407 - protein, 8 aa, Artificial Sequence
  Description of Artificial Sequence: chemically synthesized sequence
GPQGLLGA

SEQ ID NO: 408 - protein, 5 aa, Artificial Sequence
  Description of Artificial Sequence: chemically synthesized sequence
GIAGQ

SEQ ID NO: 409 - protein, 8 aa, Artificial Sequence
  Description of Artificial Sequence: chemically synthesized sequence
GPLGIAGI

SEQ ID NO: 410 - protein, 8 aa, Artificial Sequence
  Description of Artificial Sequence: chemically synthesized sequence
GPEGLRVG

SEQ ID NO: 411 - protein, 8 aa, Artificial Sequence
  Description of Artificial Sequence: chemically synthesized sequence
YGAGLGVV

SEQ ID NO: 412 - protein, 8 aa, Artificial Sequence
  Description of Artificial Sequence: chemically synthesized sequence
AGLGVVER

SEQ ID NO: 413 - protein, 8 aa, Artificial Sequence
  Description of Artificial Sequence: chemically synthesized sequence
AGLGISST

SEQ ID NO: 414 - protein, 8 aa, Artificial Sequence
  Description of Artificial Sequence: chemically synthesized sequence
EPQALAMS

SEQ ID NO: 415 - protein, 8 aa, Artificial Sequence
  Description of Artificial Sequence: chemically synthesized sequence
QALAMSAI

SEQ ID NO: 416 - protein, 8 aa, Artificial Sequence
  Description of Artificial Sequence: chemically synthesized sequence
AAYHLVSQ

SEQ ID NO: 417 - protein, 8 aa, Artificial Sequence
  Description of Artificial Sequence: chemically synthesized sequence
MDAFLESS

SEQ ID NO: 418 - protein, 8 aa, Artificial Sequence
  Description of Artificial Sequence: chemically synthesized sequence
ESLPVVAV

SEQ ID NO: 419 - protein, 8 aa, Artificial Sequence
  Description of Artificial Sequence: chemically synthesized sequence
SAPAVESE

SEQ ID NO: 420 - protein, 8 aa, Artificial Sequence
  Description of Artificial Sequence: chemically synthesized sequence
DVAQFVLT

SEQ ID NO: 421 - protein, 8 aa, Artificial Sequence
  Description of Artificial Sequence: chemically synthesized sequence
VAQFVLTE

SEQ ID NO: 422 - protein, 8 aa, Artificial Sequence
  Description of Artificial Sequence: chemically synthesized sequence
AQFVLTEG

SEQ ID NO: 423 - protein, 8 aa, Artificial Sequence
  Description of Artificial Sequence: chemically synthesized sequence
PVQPIGPQ

SEQ ID NO: 424 - protein, 273 aa, Artificial Sequence
  Description of Artificial Sequence: chemically synthesized sequence
GGGSGGGGSGSGGGSGGGGSGGGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRSGGSTITSYNVYYTKLSSSGTQVQLVQTGGGVVQPGRSLRLSCAASGSTFSSYAMSWVRQAPGKGLEWVSAISGSGGSTYYADSVKGRFTISRDNSKNTLYLQMNSLRAEDTAVYYCATNSLYWYFDLWGRGTLVTVSSAS

SEQ ID NO: 425 - protein, 264 aa, Artificial Sequence
  Description of Artificial Sequence: chemically synthesized sequence
GGGSGGGGSGSGGGSGGGGSGGGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 426 - protein, 15 aa, Artificial Sequence
  Description of Artificial Sequence: chemically synthesized sequence
SCLMHPHYAHDYCYV

SEQ ID NO: 427 - DNA, 804 bp, Artificial Sequence
  Description of Artificial Sequence: chemically synthesized sequence
cagggccagtccggctcatatctgccctgccacttcgtgccaatcggggcctgtaacaataagggcggtggatctagtggtggctcaggcgggtctggcggcatttccagtggactcttgtcaggacgatccgataatcatggcgggtccgacatccagatgacacagagcccttcttccctctccgcaagcgttggcgacagggtcaccattacctgtagggcttctcagagcatctcaagctatctgaactggtaccagcagaaacctggaaaggctccaaaactgctgatttacgctgcctccagtcttcagtcaggcgtcccctccagatttagcggatcaggtagtggaactgattttacccttacaatatcttctctgcagccagaggacttcgccacatactattgtcagcaagacaatggttaccccagtacatttggcggagggacaaaggtcgagatcaaaaggaccgtagcagcaccaagcgtctttattttcccccccagtgacgaacagctgaagagcggaacagcttcagtggtgtgtctcctgaataacttctatccacgcgaggcaaaggtgcagtggaaggtggacaatgcactgcagtctggtaattcccaagaaagtgttactgagcaggattccaaggattcaacttactctctgtctagcaccctgactctttctaaagcagattatgagaagcataaggtctacgcttgcgaggtgacccaccaggggctttcctctccagttaccaagtcattcaaccggggtgagtgttgatgagaattc

SEQ ID NO: 428 - protein, 264 aa, Artificial Sequence
  Description of Artificial Sequence: chemically synthesized sequence
QGQSGSGIALCPSHFCQLPQTGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 429 - DNA, 1371 bp, Artificial Sequence
  Description of Artificial Sequence: chemically synthesized sequence
gaagtgcagctgctcgaaagcggcggaggcttggtgcagccaggagggagcctgcgactgtcttgcgcagccagcggattcactttctcttcctatgccatgagctgggttcgacaggcacccggcaaaggtctcgagtgggtgtctagcatctggcgaaacggaatagttacagtgtatgccgatagcgtgaagggtcgctttactatttcacgggataattctaagaacaccctctacctgcaaatgaatagccttagggcagaagataccgccgtgtactactgtgccaaatggtccgcagcctttgactactggggccaggggacactggtgaccgtgtcctctgcatcaaccaaggggccatcagtgttcccactcgccccatcttccaagagtacttccggcggaaccgcagcccttggctgccttgttaaggactatttcccagaacccgtgaccgtaagttggaactctggcgcccttacttctggggtgcacaccttcccagcagtgttgcagtccagtggcctttactctctgtctagtgtagtgactgtgccttcctctagtctcggtacccagacctatatttgtaatgttaaccataagcccagcaatacaaaggttgataagaaagtggaacccaagagctgcgataagacacatacctgcccaccttgtccagctcccgagctgctgggcggaccctcagtctttctcttcccacctaaacccaaggatacccttatgatctccaggactcctgaggtgacctgcgttgtggtcgacgtgtcacatgaggaccctgaggtaaagtttaactggtacgtggacggtgtggaggtacataacgctaagactaagccacgagaggagcaatacgcttccacttacagggtggtcagcgtcctgaccgttctccatcaggactggctgaacgggaaggaatataagtgtaaggttagcaacaaagctctccctgcaccaatcgagaagacaatcagcaaggcaaaagggcagcctcgggaacctcaggtctacaccctccctcctagcagggaagagatgacaaagaaccaggtctctctcacctgcctggtgaaaggcttctatccatctgacattgctgtggagtgggaatccaacggccagcctgaaaataattataagaccacaccccccgtccttgattccgatggatctttcttcctgtacagtaaactcaccgtcgacaaatcacggtggcagcaaggtaacgtgttcagctgttctgtcatgcatgaggctctgcataaccattacacacaaaagtctttgtcattgtctccaggatgatgagaattcattgatcataatcagccataccac

SEQ ID NO: 430 - protein, 445 aa, Artificial Sequence
  Description of Artificial Sequence: chemically synthesized sequence
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 431 - DNA, 1362 bp, Artificial Sequence
  Description of Artificial Sequence: chemically synthesized sequence
gaagtgcagctgctcgaaagcggcggaggcttggtgcagccaggagggagcctgcgactgtcttgcgcagccagcggattcactttctcttcctatgccatgagctgggttcgacaggcacccggcaaaggtctcgagtgggtgtctagcatctggcgaaacggaatagttacagtgtatgccgatagcgtgaagggtcgctttactatttcacgggataattctaagaacaccctctacctgcaaatgaatagccttagggcagaagataccgccgtgtactactgtgccaaatggtccgcagcctttgactactggggccaggggacactggtgaccgtgtcctctgcatcaaccaaggggccatcagtgttcccactcgccccatgtagcagatcaacatctgaatccaccgcagcccttggctgccttgttaaggactatttcccagaacccgtgaccgtaagttggaactctggcgcccttacttctggggtgcacaccttcccagcagtgttgcagtccagtggcctttactctctgtctagtgtagtgactgtgccttcctctagtctcggtaccaagacctatacctgcaacgtagatcataagcccagcaatacaaaggttgataagagagtagagtcaaagtacggcccaccctgcccaccttgtccagctcccgagttcctgggcggaccctcagtctttctcttcccacctaaacccaaggatacccttatgatctccaggactcctgaggtgacctgcgttgtggtcgacgtgtcacaagaggaccctgaggtacagtttaactggtacgtggacggtgtggaggtacataacgctaagactaagccacgagaggagcaatttaactccacttacagggtggtcagcgtcctgaccgttctccatcaggactggctgaacgggaaggaatataagtgtaaggttagcaacaaaggtctgcccagttctatcgagaagacaatcagcaaggcaaaagggcagcctcgggaacctcaggtctacaccctccctcctagccaggaagagatgacaaagaaccaggtctctctcacctgcctggtgaaaggcttctatccatctgacattgctgtggagtgggaatccaacggccagcctgaaaataattataagaccacaccccccgtccttgattccgatggatctttcttcctgtacagtcgcctcaccgtcgacaaatcacggtggcaggaaggtaacgtgttcagctgttctgtcatgcatgaggctctgcataaccattacacacaaaagtctttgtcattgtctctcggatgatgagaattcattgatcataatcagccataccac

SEQ ID NO: 432 - protein, 442 aa, Artificial Sequence
  Description of Artificial Sequence: chemically synthesized sequence
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 433 - DNA, 1371 bp, Artificial Sequence; identical to SEQ ID NO: 429
  Description of Artificial Sequence: chemically synthesized sequence

SEQ ID NO: 434 - protein, 445 aa, Artificial Sequence
  Description of Artificial Sequence: chemically synthesized sequence
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 435 - protein, 12 aa, Artificial Sequence
  Description of Artificial Sequence: chemically synthesized sequence
NTLSGRSENHSG

SEQ ID NO: 436 - protein, 12 aa, Artificial Sequence
  Description of Artificial Sequence: chemically synthesized sequence
NTLSGRSGNHGS

SEQ ID NO: 437 - protein, 12 aa, Artificial Sequence
  Description of Artificial Sequence: chemically synthesized sequence
TSTSGRSANPRG

SEQ ID NO: 438 - protein, 8 aa, Artificial Sequence
  Description of Artificial Sequence: chemically synthesized sequence
TSGRSANP

SEQ ID NO: 439 - protein, 8 aa, Artificial Sequence
  Description of Artificial Sequence: chemically synthesized sequence
VAGRSMRP

SEQ ID NO: 440 - protein, 8 aa, Artificial Sequence
  Description of Artificial Sequence: chemically synthesized sequence
VVPEGRRS

SEQ ID NO: 441 - protein, 8 aa, Artificial Sequence
  Description of Artificial Sequence: chemically synthesized sequence
ILPRSPAF

SEQ ID NO: 442 - protein, 8 aa, Artificial Sequence
  Description of Artificial Sequence: chemically synthesized sequence
MVLGRSLL

SEQ ID NO: 443 - protein, 8 aa, Artificial Sequence
  Description of Artificial Sequence: chemically synthesized sequence
QGRAITFI

SEQ ID NO: 444 - protein, 8 aa, Artificial Sequence
  Description of Artificial Sequence: chemically synthesized sequence
SPRSIMLA

SEQ ID NO: 445 - protein, 8 aa, Artificial Sequence
  Description of Artificial Sequence: chemically synthesized sequence
SMLRSMPL

SEQ ID NO: 446 - protein, 12 aa, Artificial Sequence
  Description of Artificial Sequence: chemically synthesized sequence
DYFWSGFSAFDI

SEQ ID NO: 447 - protein, 7 aa, Artificial Sequence
  Description of Artificial Sequence: chemically synthesized sequence
KASTLES

SEQ ID NO: 448 - protein, 9 aa, Artificial Sequence
  Description of Artificial Sequence: chemically synthesized sequence
QQSYSTPWT

SEQ ID NO: 449 - protein, 120 aa, Artificial Sequence
  Description of Artificial Sequence: chemically synthesized sequence
QMQLVQSGGGLVQPGGSLRLSCAASGFTFSSYWMSWVRQAPGKGLEWVANIKQDGSEKYYVDSVKGRFTISRDNAKNSLYLQMNSLRAEDTAVYYCARDYFWSGFSAFDIWGKGTLVTVS

SEQ ID NO: 450 - protein, 107 aa, Artificial Sequence
  Description of Artificial Sequence: chemically synthesized sequence
DIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIK

SEQ ID NO: 451 - protein, 118 aa, Artificial Sequence
  Description of Artificial Sequence: chemically synthesized sequence
EVQLVESGGGLVQPGGSLRLSCAASGFTFSGSWIHWVRQAPGKGLEWVAWILPYGGSSYYADSVKGRFTISADTSKNTAYLQMNSLRAEDTAVYYCARRHWPGGFDYWGQGTLVTVSA

SEQ ID NO: 452 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYYNVPWTFGQGTKVEIKR

SEQ ID NO: 453 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYYAPPWTFGQGTKVEIKR

SEQ ID NO: 454 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYYTVPWTFGQGTKVEIKR

SEQ ID NO: 455 - protein, 108 aa, Artificial Sequence
  Description of Artificial Sequence: chemically synthesized sequence
DIQMTQSPSSLSASVGDRVTITCRASQVINTFLAWYQQKPGKAPKLLIYSASTLASGVPSRFSGSGSGTDFTLTISSLQPEDFATYYCQQYYTVPRTFGQGTKVEIKR

SEQ ID NO: 456 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQGYGVPRTFGQGTKVEIKR

SEQ ID NO: 457 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYLFTPPTFGQGTKVEIKR

SEQ ID NO: 458 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYFITPTTFGQGTKVEIKR

SEQ ID NO: 459 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYYYTPPTFGQGTKVEIKR

SEQ ID NO: 460 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQFFYTPPTFGQGTKVEIKR

SEQ ID NO: 461 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQSLFTPPTFGQGTKVEIKR

SEQ ID NO: 462 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQSLYTPPTFGQGTKVEIKR

SEQ ID NO: 463 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQSWYHPPTFGQGTKVEIKR

SEQ ID NO: 464 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYFYIPPTFGQGTKVEIKR

SEQ ID NO: 465 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYWYTPTTFGQGTKVEIKR

SEQ ID NO: 466 - protein, 108 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQSYFIPPTFGQGTKVEIKR

SEQ ID NO: 467 - protein, 141 aa, Artificial Sequence
  Description of Artificial Sequence: chemically synthesized sequence
METGLRWLLLVAVLKGVQCLSVEESGGRLVTPGTPLTLTCTASGFTITNYHMFWVRQAPGKGLEWIGVITSSGIGSSSTTYYATWAKGRFTISKTSTTVNLRITSPTTEDTATYFCARDYFTNTYYALDIWGPGTLVTVSS

SEQ ID NO: 468 - protein, 118 aa, Artificial Sequence
  Description of Artificial Sequence: chemically synthesized sequence
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 469 - protein, 113 aa, Artificial Sequence
  Description of Artificial Sequence: chemically synthesized sequence
EVQLVESGGGLVQPGRSLRLSCAVSGFTFDDYVVHWVRQAPGKGLEWVSGISGNSGNIGYADSVKGRFTISRDNAKNSLYLQMNSLRAEDTALYYCAVPFDYWGQGTLVTVSS

SEQ ID NO: 470 - protein, 116 aa, Artificial Sequence
  Description of Artificial Sequence: chemically synthesized sequence
MDTRAPTQLLGLLLLWLPGARCALVMTQTPSSTSTAVGGTVTIKCQASQSISVYLAWYQQKPGQPPKLLIYSASTLASGVPSRFKGSRSGTEYTLTISGVQREDAATYYCLGSAGS

SEQ ID NO: 471 - protein, 120 aa, Artificial Sequence
  Description of Artificial Sequence: chemically synthesized sequence
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 472 - protein, 110 aa, Artificial Sequence
  Description of Artificial Sequence: chemically synthesized sequence
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 473 - protein, 118 aa, Artificial Sequence
  Description of Artificial Sequence: chemically synthesized sequence
EVKLQESGPSLVKPSQTLSLTCSVTGYSITSDYWNWIRKFPGNKLEYVGYISYTGSTYYNPSLKSRISITRDTSKNQYYLQLNSVTSEDTATYYCARYGGWLSPFDYWGQGTTLTVSS

SEQ ID NO: 474 - protein, 120 aa, Artificial Sequence
  Description of Artificial Sequence: chemically synthesized sequence
EVQLQESGPGLVAPSQSLSITCTVSGFSLTTYSINWIRQPPGKGLEWLGVMWAGGGTNSNSVLKSRLIISKDNSKSQVFLKMNSLQTDDTARYYCARYYGNSPYYAIDYWGQGTSVTVSS

SEQ ID NO: 475 - protein, 118 aa, Artificial Sequence
  Description of Artificial Sequence: chemically synthesized sequence
EVKLQESGPSLVKPSQTLSLTCSVTGYSIISDYWNWIRKFPGNKLEYLGYISYTGSTYYNPSLKSRISITRDTSKNQYYLQLNSVTTEDTATYYCARRGGWLLPFDYWGQGTTLTVSS

SEQ ID NO: 476 - protein, 118 aa, Artificial Sequence
  Description of Artificial Sequence: chemically synthesized sequence
EVKLQESGPSLVKPGASVKLSCKASGYTFTSYDINWVKQRPGQGLEWIGWIFPRDNNTKYNENFKGKATLTVDTSSTTAYMELHSLTSEDSAVYFCTKENWVGDFDYWGQGTTLTLSS

SEQ ID NO: 477 - protein, 114 aa, Artificial Sequence
  Description of Artificial Sequence: chemically synthesized sequence
EVQLQQSGPDLVTPGASVRISCQASGYTFPDYYMNWVKQSHGKSLEWIGDIDPNYGGTTYNQKFKGKAILTVDRSSSTAYMELRSLTSEDSAVYYCARGALTDWGQGTSLTVSS

SEQ ID NO: 478 - protein, 106 aa, Artificial Sequence
  Description of Artificial Sequence: chemically synthesized sequence
EIVLTQSPATLSLSPGERATLSCRASSSVSYIYWFQQKPGQSPRPLIYAAFNRATGIPARFSGSGSGTDYTLTISSLEPEDFAVYYCQQWSNNPLTFGQGTKVEIK

SEQ ID NO: 479 - protein, 114 aa, Artificial Sequence
  Description of Artificial Sequence: chemically synthesized sequence
QVQLVQSGAEVKKPGASVKVSCKASGYTFPDYYMNWVRQAPGQGLEWMGDIDPNYGGTNYAQKFQGRVTMTRDTSISTAYMELSRLRSDDTAVYYCARGALTDWGQGTMVTVSS

SEQ ID NO: 480 - protein, 114 aa, Artificial Sequence
  Description of Artificial Sequence: chemically synthesized sequence
QVQLVQSGAEVKKPGASVKVSCKASGYTFPDYYMNWVRQAPGQSLEWMGDIDPNYGGTNYNQKFQGRVTMTRDTSISTAYMELSRLRSDDTAVYYCARGALTDWGQGTMVTVSS

SEQ ID NO: 481 - protein, 114 aa, Artificial Sequence
  Description of Artificial Sequence: chemically synthesized sequence
EVQLVQSGAEVKKPGASVKVSCKASGYTFPDYYMNWVRQAPGQSLEWMGDIDPNYGGTNYNQKFQGRVTMTVDRSSSTAYMELSRLRSDDTAVYYCARGALTDWGQGTMVTVSS

SEQ ID NO: 482 - protein, 114 aa, Artificial Sequence
  Description of Artificial Sequence: chemically synthesized sequence
EVQLVESGGGLVQPGRSLRLSCTASGYTFPDYYMNWVRQAPGKGLEWVGDIDPNYGGTTYAASVKGRFTISVDRSKSIAYLQMSSLKTEDTAVYYCTRGALTDWGQGTMVTVSS

SEQ ID NO: 483 - protein, 114 aa, Artificial Sequence
  Description of Artificial Sequence: chemically synthesized sequence
EVQLVESGGGLVQPGRSLRLSCTASGYTFPDYYMNWVRQAPGKGLEWVGDIDPNYGGTTYNASVKGRFTISVDRSKSIAYLQMSSLKTEDTAVYYCARGALTDWGQGTMVTVSS

SEQ ID NO: 484 - protein, 107 aa, Artificial Sequence
  Description of Artificial Sequence: chemically synthesized sequence
DIVMTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 485 - protein, 107 aa, Artificial Sequence
  Description of Artificial Sequence: chemically synthesized sequence
DIVTTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 486 - protein, 113 aa, Artificial Sequence
  Description of Artificial Sequence: chemically synthesized sequence
DIVMTQSPSSLAVSVGEKVSMGCKSSQSLLYSSNQKNSLAWYQQKPGQSPKLLIDWASTRESGVPDRFTGSGSGTDFTLTISSVKAEDLAVYYCQQYYGYPLTFGAGTKLELK

SEQ ID NO: 487 - protein, 106 aa, Artificial Sequence
  Description of Artificial Sequence: chemically synthesized sequence
DIVMTQSPAIMSASPGEKVTMTCSASSSIRYMHWYQQKPGTSPKRWISDTSKLTSGVPARFSGSGSGTSYALTISSMEAEDAATYYCHQRSSYPWTFGGGTKLEIK

SEQ ID NO: 488 - protein, 106 aa, Artificial Sequence
  Description of Artificial Sequence: chemically synthesized sequence
QIVLSQSPAILSASPGEKVTMTCRASSSVSYIYWFQQKPGSSPKPWIYATFNLASGVPARFSGSGSGTSYSLTISRVETEDAATYYCQQWSNNPLTFGAGTKLELK

SEQ ID NO: 489 - protein, 106 aa, Artificial Sequence
  Description of Artificial Sequence: chemically synthesized sequence
EIVLTQSPATLSLSPGERATLSCRASSSVSYIYWFQQKPGQAPRLLIYAAFNRATGIPARFSGSGSGTDYTLTISSLEPEDFAVYYCQQWSNNPLTFGQGTKVEIK

SEQ ID NO: 490 - protein, 106 aa, Artificial Sequence
  Description of Artificial Sequence: chemically synthesized sequence
QIVLTQSPATLSLSPGERATLSCRASSSVSYIYWFQQKPGQSPRPLIYATFNLASGIPARFSGSGSGTSYTLTISRLEPEDFAVYYCQQWSNNPLTFGQGTKVEIK

SEQ ID NO: 491 - protein, 106 aa, Artificial Sequence
  Description of Artificial Sequence: chemically synthesized sequence
DIQLTQSPSSLSASVGDRVTITCRASSGVSYIYWFQQKPGKAPKLLIYAAFNLASGVPSRFSGSGSGTEYTLTISSLQPEDFATYYCQQWSNNPLTFGQGTKVEIK

SEQ ID NO: 492 - protein, 106 aa, Artificial Sequence
  Description of Artificial Sequence: chemically synthesized sequence
DIQLTQSPSSLSASVGDRVTITCRASSGVSYIYWFQQKPGKAPKPLIYAAFNLASGVPSRFSGSGSGTEYTLTISSLQPEDFATYYCQQWSNNPLTFGQGTKVEIK

SEQ ID NO: 493 - protein, 106 aa, Artificial Sequence
  Description of Artificial Sequence: chemically synthesized sequence
DIQLTQSPSILSASVGDRVTITCRASSSVSYIYWFQQKPGKAPKPLIYATFNLASGVPSRFSGSGSGTSYTLTISSLQPEDFATYYCQQWSNNPLTFGQGTKVEIK

SEQ ID NO: 494 - protein, 124 aa, Artificial Sequence
  Description of Artificial Sequence: chemically synthesized sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARALPSGTILVGGWFDPWGQGTLVTVSS

SEQ ID NO: 495 - protein, 124 aa, Artificial Sequence
  Description of Artificial Sequence: chemically synthesized sequence
EVQLVQSGGGVVQPGRSLRLSCAASGFTFSSYALSWVRQAPGKGLEWVSAISGGGGSTYYADSVKGRFTISRDNSKNTLYLQMNSLRAEDTAVYYCAKDVFPETFSMNYGMDVWGQGTLVTVSS

SEQ ID NO: 496 - protein, 128 aa, Artificial Sequence
  Description of Artificial Sequence: chemically synthesized sequence
QVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKVLLPCSSTSCYGSVGAFDIWGQGTTVTVSS

SEQ ID NO: 497 - protein, 117 aa, Artificial Sequence
  Description of Artificial Sequence: chemically synthesized sequence
QVQLVQSGGSVVRPGESLRLSCVASGFIFDNYDMSWVRQVPGKGLEWVSRVNWNGGSTTYADAVKGRFTISRDNTKNSLYLQMNNLRAEDTAVYYCVREFVGAYDLWGQGTTVTVSS

SEQ ID NO: 498 - protein, 121 aa, Artificial Sequence
  Description of Artificial Sequence: chemically synthesized sequence
QVQLVQSGAEVKKPGATVKVSCKVFGDTFRGLYIHWVRQAPGQGLEWMGGIIPIFGTANYAQKFQGRVTITTDESTSTAYMELSSLRSEDTAVYYCASGLRWGIWGWFDPWGQGTLVTVSS

SEQ ID NO: 499 - protein, 121 aa, Artificial Sequence
  Description of Artificial Sequence: chemically synthesized sequence
EVQLVQSGAELKKPGSSVKVSCKAFGGTFSDNAISWVRQAPGQGPEWMGGIIPIFGKPNYAQKFQGRVTITADESTSTAYMVLSSLRSEDTAVYYCARTMVRGFLGVMDVWGQGTTVTVSS

SEQ ID NO: 500 - protein, 125 aa, Artificial Sequence
  Description of Artificial Sequence: chemically synthesized sequence
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDQFVTIFGVPRYGMDVWGQGTTVTVSS

SEQ ID NO: 501 - protein, 120 aa, Artificial Sequence
  Description of Artificial Sequence: chemically synthesized sequence
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGRQMFGAGIDFWGPGTLVTVSS

SEQ ID NO: 502 - protein, 118 aa, Artificial Sequence
  Description of Artificial Sequence: chemically synthesized sequence
EVQLVESGAEVKKPGSSVKVSCKVSGGTFGTYALNWVRQAPGQGLEWMGRIVPLIGLVNYAHNFEGRISITADKSTGTAYMELSNLRSDDTAVYYCAREVYGGNSDYWGQGTLVTVSS

SEQ ID NO: 503 - protein, 120 aa, Artificial Sequence
  Description of Artificial Sequence: chemically synthesized sequence
QVQLVQSGGEVKKPGASVKVSCKASGYTLSSHGITWVRQAPGQGLEWMGWISAHNGHASNAQKVEDRVTMTTDTSTNTAYMELRSLTADDTAVYYCARVHAALYYGMDVWGQGTLVTVSS

SEQ ID NO: 504 - protein, 121 aa, Artificial Sequence
  Description of Artificial Sequence: chemically synthesized sequence
QVQLQESGGGVVQPGRSLRLSCSASGFTFSRHGMHWVRQAPGKGLEWVAVISHDGSVKYYADSMKGRFSISRDNSNNTLYLQMDSLRADDTAVYYCARGLSYQVSGWFDPWGQGTLVTVSS

SEQ ID NO: 505 - protein, 110 aa, Artificial Sequence
  Description of Artificial Sequence: chemically synthesized sequence
NFMLTQPHSVSESPGKTVTISCTRSSGSIASNYVQWYQQRPGSSPTTVIYEDNQRPSGVPDRFSGSIDTSSNSASLTISGLKTKDEADYYCQSYDGITVIFGGGTKLTVL

SEQ ID NO: 506 - protein, 111 aa, Artificial Sequence
  Description of Artificial Sequence: chemically synthesized sequence
NFMLTQPHSVSGSPGKTVTLPCTRSSGSIASHYVQWYQQRPGSAPTTVIYEDNKRPSGVPDRFSGSIDSSSNSASLSISGLKTEDEADYYCQSYDSSNRWVFGGGTKLTVL

SEQ ID NO: 507 - protein, 115 aa, Artificial Sequence
  Description of Artificial Sequence: chemically synthesized sequence
LPVLTQPASLSASPGASASLTCTLRSGLNVGSYRIYWYQQKPGSRPQYLLNYKSDSNKQQASGVPSRFSGSKDASANAGILLISGLQSEDEADYYCMIWYSSAVVFGGGTKLTVL

SEQ ID NO: 508 - protein, 111 aa, Artificial Sequence
  Description of Artificial Sequence: chemically synthesized sequence
NFMLTQPHSVSESPGKTVTISCTRSSGNIASNYVQWYQQRPGSAPTTVIYEDNQRPSGVPDRFSGSIDSSSNSASLTISGLKTEDEADYYCQSYDSSNLWVFGGGTKLTVL

SEQ ID NO: 509 - protein, 108 aa, Artificial Sequence
  Description of Artificial Sequence: chemically synthesized sequence
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHYVFGTGTKVTVL

SEQ ID NO: 510 - protein, 108 aa, Artificial Sequence
  Description of Artificial Sequence: chemically synthesized sequence
LPVLTQAPSVSVAPGKTARITCGGSDIGRKSVHWYQQKPGQAPALVIYSDRDRPSGISERFSGSNSGNTATLTISRVEAGDEADYYCQVWDNNSDHYVFGAGTELIVL

SEQ ID NO: 511 - protein, 109 aa, Artificial Sequence
  Description of Artificial Sequence: chemically synthesized sequence
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSTLPFGGGTKLTVL

SEQ ID NO: 512 - protein, 107 aa, Artificial Sequence
  Description of Artificial Sequence: chemically synthesized sequence
EIVLTQSPATLSLSPGERATLSCRASQSIGNSLAWYQQKPGQAPRLLMYGASSRATGIPDRFSGSGAGTDFTLTISSLEPEDFATYYCQQHTIPTFSFGPGTKVEVK

SEQ ID NO: 513 - protein, 107 aa, Artificial Sequence
  Description of Artificial Sequence: chemically synthesized sequence
DIVMTQTPSFLSASIGDRVTITCRASQGIGSYLAWYQQRPGEAPKLLIYAASTLQSGVPSRFSGSGSGTDFTLTISNLQPEDFATYYCQQLNNYPITFGQGTRLEIK

SEQ ID NO: 514 - protein, 105 aa, Artificial Sequence
  Description of Artificial Sequence: chemically synthesized sequence
QSALTQPPSVSVSPGQTANIPCSGDKLGNKYAYWYQQKPGQSPVLLIYQDIKRPSRIPERFSGSNSADTATLTISGTQAMDEADYYCQTWDNSVVFGGGTKLTVL

SEQ ID NO: 515 - protein, 112 aa, Artificial Sequence
  Description of Artificial Sequence: chemically synthesized sequence
NFMLTQPHSVSESPGKTVTISCTRSSGSIDSNYVQWYQQRPGSAPTTVIYEDNQRPSGVPDRFSGSIDSSSNSASLTISGLKTEDEADYYCQSYDSNNRHVIFGGGTKLTVL

SEQ ID NO: 516 - protein, 110 aa, Artificial Sequence
  Description of Artificial Sequence: chemically synthesized sequence
NFMLTQPHSVSESPGKTVTISCTRSSGNIGTNYVQWYQQRPGSAPVALIYEDYRRPSGVPDRFSGSIDSSSNSASLIISGLKPEDEADYYCQSYHSSGWEFGGGTKLTVL

SEQ ID NO: 517 - protein, 108 aa, Artificial Sequence
  Description of Artificial Sequence: chemically synthesized sequence
QSVLTQPPSVSVAPGQTARITCGGNNIGSKGVHWYQQKPGQAPVLVVYDDSDRPSGIPERFSGSNSGNTATLTISRVEAGDEADYYCQVWDSSSDHWVFGGGTKLTVL

SEQ ID NO: 518 - protein, 111 aa, Artificial Sequence
  Description of Artificial Sequence: chemically synthesized sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTTPSVFGGGTKLTVL

SEQ ID NO: 519 - protein, 120 aa, Artificial Sequence
  Description of Artificial Sequence: chemically synthesized sequence
QVQLVQSGAEVKKPGASVKVSCKASGYTFTSYGISWVRQAPGQGLEWMGWTSPHNGLTAFAQILEGRVTMTTDTSTNTAYMELRNLTFDDTAVYFCAKVHPVFSYALDVWGQGTLVTVSS

SEQ ID NO: 520 - protein, 118 aa, Artificial Sequence
  Description of Artificial Sequence: chemically synthesized sequence
EVQLVESGAEVMNPGSSVRVSCRGSGGDFSTYAFSWVRQAPGQGLEWMGRIIPILGIANYAQKFQGRVTITADKSTSTAYMELSSLRSDDTAVYYCARDGYGSDPVLWGQGTLVTVSS

SEQ ID NO: 521 - protein, 118 aa, Artificial Sequence
  Description of Artificial Sequence: chemically synthesized sequence
EVQLVQSGAEVKKPGASVKVSCKASGYTFTNYGISWVRQAPGQGLEWMGWISAYNGNTNYAQKVQGRVTMTTDTSTSTGYMELRSLRSDDTAVYYCARGDFRKPFDYWGQGTLVTVSS

SEQ ID NO: 522 - protein, 115 aa, Artificial Sequence
  Description of Artificial Sequence: chemically synthesized sequence
EVQLVQSGPELKKPGASVKMSCKASGYTFTSYVMHWVKQAPGQRLEWIGYVNPFNDGTKYNEMFKGRATLTSDKSTSTAYMELSSLRSEDSAVYYCARQAWGYPWGQGTLVTVSS

SEQ ID NO: 523 - protein, 115 aa, Artificial Sequence
  Description of Artificial Sequence: chemically synthesized sequence
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 524 - protein, 115 aa, Artificial Sequence
  Description of Artificial Sequence: chemically synthesized sequence
EVQLVQSGAEVKKPGASVKMSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 525 - protein, 115 aa, Artificial Sequence
  Description of Artificial Sequence: chemically synthesized sequence
EVQLVQSGAEVKKPGASVKVSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 526 - protein, 115 aa, Artificial Sequence
  Description of Artificial Sequence: chemically synthesized sequence
EVQLVQSGAEVKKPGASVKVSCKASGYTFTSYVMHWVRQAPGQRLEWIGYVNPFNDGTKYNEMFKGRATITSDKSTSTAYMELSSLRSEDTAVYYCARQAWGYPWGQGTLVTVSS

SEQ ID NO: 527 - protein, 111 aa, Artificial Sequence
  Description of Artificial Sequence: chemically synthesized sequence
DIVLTQSPASLALSPGERATLSCRATESVEYYGTSLVQWYQQKPGQPPKLLIYAASSVDSGVPSRFSGSGSGTDFTLTINSLEEEDAAMYFCQQSRRVPYTFGQGTKLEIK

SEQ ID NO: 528 - protein, 111 aa, Artificial Sequence
  Description of Artificial Sequence: chemically synthesized sequence
DIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 529 - protein, 111 aa, Artificial Sequence
  Description of Artificial Sequence: chemically synthesized sequence
EIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 530 - protein, 111 aa, Artificial Sequence
  Description of Artificial Sequence: chemically synthesized sequence
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 531 - protein, 123 aa, Artificial Sequence
  Description of Artificial Sequence: chemically synthesized sequence
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGTIYDSSGYSFDYWGQGTLVTVSS

SEQ ID NO: 532 - protein, 124 aa, Artificial Sequence
  Description of Artificial Sequence: chemically synthesized sequence
EVQLVQSGAEVKKPGSSVKVSCKASGGTFSSYAISWVRQAPGQGLEWMGIINPSGGSTSYAQKFQGRVSMTRDTSTSTVYMELSSLTSEDTAVYYCARDLFPHIYGNYYGMDIWGQGTTVTVSS

SEQ ID NO: 533 - protein, 118 aa, Artificial Sequence
  Description of Artificial Sequence: chemically synthesized sequence
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARLAVPGAFDIWGQGTMVTVSS

SEQ ID NO: 534 - protein, 116 aa, Artificial Sequence
  Description of Artificial Sequence: chemically synthesized sequence
EVQLVESGGGVVQPGRSLRLSCAASGFTFSSYAMHWVRQAPGKGLAVISYDGSNKYYADSVKGRFTISRDNSKNTLYLQMNSLRAEDTAVYYCARGQWLVTELDYWGQGTLVTVSS

SEQ ID NO: 535 - protein, 122 aa, Artificial Sequence
  Description of Artificial Sequence: chemically synthesized sequence
EVQLVESGSEVEKPGSSVKVSCKASGGTFSDSGISWVRQAPGQGLEWMGGIIPMFATPYYAQKFQDRVTITADESTSTVYMELSGLRSDDTAVFYCARDRGRGHLPWYFDLWGRGTLVTVSS

SEQ ID NO: 536 - protein, 119 aa, Artificial Sequence
  Description of Artificial Sequence: chemically synthesized sequence
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARAPYYYYYMDVWGQGTTVTVSS

SEQ ID NO: 537 - protein, 124 aa, Artificial Sequence
  Description of Artificial Sequence: chemically synthesized sequence
EVQLLESGAEVKKPGSSVKVSCKASGGTLSRYALSWVRQAPGQGPEWVGAIIPIFGTPHYSKKFQDRVIITVDTSTNTAFMELSSLRFEDTALYFCARGHDEYDISGYHRLDYWGQGTLVTVSS

SEQ ID NO: 538 - protein, 121 aa, Artificial Sequence
  Description of Artificial Sequence: chemically synthesized sequence
QVQLVQSGSELKKPGSSVKVSCKASGYSFSGYYIHWVRQAPGQGLEWMGWIDPNSGVTNYVRRFQGRVTMTRDTSLSTAYMELSGLTADDTAVYYCARDENLWQFGYLDYWGQGTLVTVSS

SEQ ID NO: 539 - protein, 120 aa, Artificial Sequence
  Description of Artificial Sequence: chemically synthesized sequence
QVQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 540 - protein, 118 aa, Artificial Sequence
  Description of Artificial Sequence: chemically synthesized sequence
QVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 541 - protein, 118 aa, Artificial Sequence
  Description of Artificial Sequence: chemically synthesized sequence
EVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 542 - protein, 121 aa, Artificial Sequence
  Description of Artificial Sequence: chemically synthesized sequence
EVQLVQSGGGLVQPGGSLRLSCAASGFTFSDYGMHWVRQPPGKGLEWLAVISYDGSYKIHADSVQGRFTISRDNAKNSVFLQMNSLKTEDTAVYYCTTDRKWLAWHGMDVWGQGTTVTVSS

SEQ ID NO: 543 - protein, 118 aa, Artificial Sequence
  Description of Artificial Sequence: chemically synthesized sequence
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGIVADFQHWGQGTLVTVSS

SEQ ID NO: 544 - protein, 121 aa, Artificial Sequence
  Description of Artificial Sequence: chemically synthesized sequence
EVQLVESGAEVKKPGASVKVSCKASGDTFSRYGITWVRQAPGRGLEWMGNIVPFFGATNYAQKFQGRLTITADKSSYTSYMDLSSLRSDDTAVYYCARDHFYGSGGYFDYWGQGTLVTVSS

SEQ ID NO: 545 - protein, 121 aa, Artificial Sequence
  Description of Artificial Sequence: chemically synthesized sequence
EVQLLESGAEVKKPGASVKVSCKASGYTFNSYDINWVRQAPGQGLEWMGGIIPVFGTANYAESFQGRVTMTADHSTSTAYMELNNLRSEDTAVYYCARDRWHYESRPMDVWGQGTTVTVSS

SEQ ID NO: 546 - protein, 119 aa, Artificial Sequence
  Description of Artificial Sequence: chemically synthesized sequence
EVQLVESGGGLVRPGGSLRLACAASGFSFSDYYMTWIRQAPGRGLEWIAYISDSGQTVHYADSVKGRFTISRDNTKNSLFLQVNTLRAEDTAVYYCAREDLLGYYLQSWGQGTLVTVSS

SEQ ID NO: 547 - protein, 131 aa, Artificial Sequence
  Description of Artificial Sequence: chemically synthesized sequence
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDEPRAVAGSQAYYYYGMDVWGQGTTVTVSS

SEQ ID NO: 548 - protein, 124 aa, Artificial Sequence
  Description of Artificial Sequence: chemically synthesized sequence
EVQLVQSGAEVKKPGASVKVSCKASGYTFTSYYMHWVRQAPGQGLEWMGIINPSDGSTSYAQKFQGRVTMTRDTSTSTVHMELSSLRSEDTAVYYCARDLFPHIYGNYYGMDIWGQGTTVTVSS

SEQ ID NO: 549 - protein, 118 aa, Artificial Sequence
  Description of Artificial Sequence: chemically synthesized sequence
QMQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 550 - protein, 118 aa, Artificial Sequence
  Description of Artificial Sequence: chemically synthesized sequence
QVQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 551 - protein, 110 aa, Artificial Sequence
  Description of Artificial Sequence: chemically synthesized sequence
QSVLTQPPSVSAAPGQKVTISCSGNNSNIANNYVSWYQQLPGTAPKLLIYDNNYRPSGIPDRFSGSKSGTSATLDITGLQTGDEADYYCGVWDGSLTTGVFGGGTKLTVL

SEQ ID NO: 552 - protein, 107 aa, Artificial Sequence
  Description of Artificial Sequence: chemically synthesized sequence
AIQMTQSPSSLSASVGDRVTITCRASQGISNYLAWYQQKPGKVPKLLIYAASTLESGVPSRFSGSGSGTDFTLTISSLQPEDLATYYCQQLHTFPLTFGGGTKVEIK

SEQ ID NO: 553 - protein, 111 aa, Artificial Sequence
  Description of Artificial Sequence: chemically synthesized sequence
QPVLTQPPSASGSPGQSVTISCTGTSSDVGAYNFVSWYRQHPGKAPKLMIYEVNKRPSGVPDRFSGSKSGNTASLTVSGLQAEDEADYYCSSYAGTNSLGIFGTGTKLTVL

SEQ ID NO: 554 - protein, 111 aa, Artificial Sequence
  Description of Artificial Sequence: chemically synthesized sequence
QSVVTQPPSVSAAPGQKVTISCSGSSSDIGNHYVSWYQQLPGTAPKLLIYDNNQRPSGIPDRFSGSKSGTSATLAITGLQTGDEADYYCGTWDNSLSPHLLFGGGTKLTVL

SEQ ID NO: 555 - protein, 110 aa, Artificial Sequence
  Description of Artificial Sequence: chemically synthesized sequence
QSVLTQPPSVSAAPGQKVTISCSGSSSNMGNNYVSWYKQVPGTAPKLLIYENDKRPSGIPDRFSGSKSGTSATLGITGLQTGDEADYYCGTWDNSLSGFVFASGTKVTVL

SEQ ID NO: 556 - protein, 109 aa, Artificial Sequence
  Description of Artificial Sequence: chemically synthesized sequence
QSALTQPASVSGSLGQSVTISCTGSSSDVGSYNLVSWYQQHPGKAPNLMIYDVSKRSGVSNRFSGSKSGNTASLTISGLQAEDEADYYCSSYTGISTVVFGGGTKLTVL

SEQ ID NO: 557 - protein, 110 aa, Artificial Sequence
  Description of Artificial Sequence: chemically synthesized sequence
QSVLTQPASVSGSPGQSITISCTGTSSDVGSYNLVSWYQQHPGKAPKLMIYEVSKRPSGVSNRFSGSKSGNTASLTISGLQAEDEADYYCSSYGGFNNLLFGGGTKLTVL

SEQ ID NO: 558 - protein, 107 aa, Artificial Sequence
  Description of Artificial Sequence: chemically synthesized sequence
DIVMTQSPSSLSASIGDRVTITCRASQRISAYVNWYQQKPGKAPKVLIYAASSLRSGVPSRFSGSGSGTDFTLTISSLQPEDFATYYCQQTYSSPWTFGQGTKVEIK

SEQ ID NO: 559 - protein, 112 aa, Artificial Sequence
  Description of Artificial Sequence: chemically synthesized sequence
QSVLTQPPSASGSPGQSVTISCTGTSSDIGGYDSVSWYQQHPGKAPKLMIYDVSKRPSGVSNRFSGSKSGNTASLTISGLQAEDEADYYCSSYTSSSIFFYVFGTGTKVTVL

SEQ ID NO: 560 - protein, 110 aa, Artificial Sequence
  Description of Artificial Sequence: chemically synthesized sequence
LPVLTQPASVSGSPGQSITISCTGTTSDIGGYDYVSWYQQHPGKAPKLMIYDVSKRPSGVSNRFSGSKSGNTASLTISGLQAEDEADYYCSSYTSSSTHVFGTGTKLTVL

SEQ ID NO: 561 - protein, 111 aa, Artificial Sequence
  Description of Artificial Sequence: chemically synthesized sequence
QSALTQPASVSGSPGQSITISCTGTSSDVGGYNYVSWYQQHPGKAPKLMIYDVSNRPSGVSNRFSGSKSGNTASLTISGLQAEDEADYYCSSYRSSTLGPVFGGGTKLTVL

SEQ ID NO: 562 - protein, 110 aa, Artificial Sequence
  Description of Artificial Sequence: chemically synthesized sequence
QAGLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGYVFGTGTKLTVL

SEQ ID NO: 563 - protein, 110 aa, Artificial Sequence
  Description of Artificial Sequence: chemically synthesized sequence
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSTTHVFGTGTKVTVL

SEQ ID NO: 564 - protein, 110 aa, Artificial Sequence
  Description of Artificial Sequence: chemically synthesized sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSVWVFGGGTQLTVL

SEQ ID NO: 565 - protein, 112 aa, Artificial Sequence
  Description of Artificial Sequence: chemically synthesized sequence
QSVLTQPASVSGSPGQSITISCTGTSSDVGGYNYVSWYQQHPGRAPRLMIYDVSNRPSGVSNRFSGSKSGNTASLTISGLQAEDEGDYYCSSYTSGGTLGPVFGGGTKLTVL

SEQ ID NO: 566 - protein, 110 aa, Artificial Sequence
  Description of Artificial Sequence: chemically synthesized sequence
QAGLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 567 - protein, 107 aa, Artificial Sequence
  Description of Artificial Sequence: chemically synthesized sequence
AIRMTQSPSSLSASVGDRVTITCRASQSISNYLNWYQQRPGKAPNLLIYAASSLQSGVPSRFSGSGSGTDFTLTISSLQPEDFATYYCQQTYSTPYTFGQGTKLEIK

SEQ ID NO: 568 - protein, 111 aa, Artificial Sequence
  Description of Artificial Sequence: chemically synthesized sequence
QSVLTQPASVSGSPGQSITISCTGTSSDVGGYNYVSWYRQHPGKAPKLMIYDVSYRPSGVSNRFSGSKSGNTASLTISGLQAEDEADYYCSSYTDSSTRYVFGTGTKLTVL

SEQ ID NO: 569 - protein, 110 aa, Artificial Sequence
  Description of Artificial Sequence: chemically synthesized sequence
QPVLTQPPSASGTPGQRVAISCSGSRSNIEINSVNWYQQLPGTAPKLLIYDNNKRPSGIPDRFSGSKSGTSATLGITGLQTGDEADYYCGSWDSSLSADVFGTGTKLTVL

SEQ ID NO: 570 - protein, 110 aa, Artificial Sequence
  Description of Artificial Sequence: chemically synthesized sequence
QSVLTQPPSVSAAPGKKVTISCSGSSSNIGNNYVSWYQQLPGTAPKLLIYRNNQRPSGVPDRFSGSKSGTSASLAISGLQSEDEADYYCATWDDSLNGWVFGGGTKLTVL

SEQ ID NO: 571 - protein, 111 aa, Artificial Sequence
  Description of Artificial Sequence: chemically synthesized sequence
QSVVTQPPSVSGAPGQRVTISCTGSSSNIGAGYDVHWYQQLPGTAPKLLIYGNNNRHSGVPDRFSGSKSGTSASLAITGLQAEDEAEFFCGTWDSRLTTYVFGSGTKLTVL

SEQ ID NO: 572 - protein, 110 aa, Artificial Sequence
  Description of Artificial Sequence: chemically synthesized sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 573 - protein, 103 aa, Artificial Sequence
  Description of Artificial Sequence: chemically synthesized sequence
VIWMTQSPSSLSASVGDRVTITCAASSLQSWYQQKPGKAPKLLIYEASTLESGVPSRFSGSGSGTEFTLTISSLQPEDFATYYCQQSYSTPYTFGQGTKLEIK

SEQ ID NO: 574 - protein, 110 aa, Artificial Sequence
  Description of Artificial Sequence: chemically synthesized sequence
QSVVTQPPSVSAAPGQKVTISCSGSSSNIGNNYVSWYQQVPGTAPKLLIYDNNKRPSGIPDRFSGSNSDTSATLGITGLQTGDEADYYCGTWDSSLSAWVFGGGTKLTVL

SEQ ID NO: 575 - protein, 112 aa, Artificial Sequence
  Description of Artificial Sequence: chemically synthesized sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGSVVFGGGTKLTVL

SEQ ID NO: 576 - protein, 108 aa, Artificial Sequence
  Description of Artificial Sequence: chemically synthesized sequence
SYELMQPPSVSVAPGKTATIACGGENIGRKTVHWYQQKPGQAPVLVIYYDSDRPSGIPERFSGSNSGNTATLTISRVEAGDEADYYCLVWDSSSDHRIFGGGTKLTVL

SEQ ID NO: 577 - protein, 108 aa, Artificial Sequence
  Description of Artificial Sequence: chemically synthesized sequence
SYELMQPPSVSVAPGKTATIACGGENIGRKTVHWYQQKPGQAPVLVIYYDSDRPSGIPERFSGSNSGNTATLTISRVEAGDEADYYCQVWDSSSDHRIFGGGTKLTVL

SEQ ID NO: 578 - protein, 108 aa, Artificial Sequence; identical to SEQ ID NO: 577
  Description of Artificial Sequence: chemically synthesized sequence

SEQ ID NO: 579 - protein, 108 aa, Artificial Sequence; identical to SEQ ID NO: 577
  Description of Artificial Sequence: chemically synthesized sequence

SEQ ID NO: 580 - protein, 447 aa, Artificial Sequence
  Description of Artificial Sequence: chemically synthesized sequence
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 581 - protein, 440 aa, Artificial Sequence
  Description of Artificial Sequence: chemically synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 582 - protein, 218 aa, Artificial Sequence
  Description of Artificial Sequence: chemically synthesized sequence
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 583 - protein, 214 aa, Artificial Sequence
  Description of Artificial Sequence: chemically synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 584 - protein, 17 aa, Artificial Sequence
  Description of Artificial Sequence: chemically synthesized sequence
  MOD_RES (8)..(8): His or Asn
  MOD_RES (9)..(9): Ser or Thr
  MOD_RES (10)..(10): Arg or Ser
KSSQSLLXXXTRKNYLA

SEQ ID NO: 585 - protein, 290 aa, Artificial Sequence
  Description of Artificial Sequence: chemically synthesized sequence
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 586 - protein, 290 aa, Artificial Sequence
  Description of Artificial Sequence: chemically synthesized sequence
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHWVLLGSILLFLIVVSTVLLFLRKQVRMLDVEKCGVEDTSSKNRNDTQFEET

SEQ ID NO: 587 - protein, 288 aa, Artificial Sequence
  Description of Artificial Sequence: chemically synthesized sequence
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKCGIQDTNSKQSDTHLEET

SEQ ID NO: 588 - protein, 221 aa, Artificial Sequence [sequence omitted]

SEQ ID NO: 589 - protein, 7 aa, Artificial Sequence
  Description of Artificial Sequence: chemically synthesized sequence
WASTRES

SEQ ID NO: 590 - protein, 8 aa, Artificial Sequence
  Description of Artificial Sequence: chemically synthesized sequence
  MOD_RES (1)..(1): Gln or Lys
XQSYDVVT

SEQ ID NO: 591 - protein, 5 aa, Artificial Sequence
  Description of Artificial Sequence: chemically synthesized sequence
  MOD_RES (4)..(4): Ile or Met
SYWXH

SEQ ID NO: 592 - protein, 17 aa, Artificial Sequence
  Description of Artificial Sequence: chemically synthesized sequence
  MOD_RES (7)..(7): Asp or Gly
  MOD_RES (9)..(9): His or Asn
  MOD_RES (12)..(12): Ser or Asn
  MOD_RES (13)..(13): Glu or Gln
  MOD_RES (16)..(16): Ile or Met
YINPSSXYXEYXXKFXD

SEQ ID NO: 593 - protein, 13 aa, Artificial Sequence
  Description of Artificial Sequence: chemically synthesized sequence
  MOD_RES (5)..(5): Ile or Val
  MOD_RES (13)..(13): Phe or Tyr
SGWLXHGDYYFDX

SEQ ID NO: 594 - protein, 17 aa, Artificial Sequence
  Description of Artificial Sequence: chemically synthesized sequence
KSSQSLLNSRTRKNYLA

SEQ ID NO: 595 - protein, 8 aa, Artificial Sequence
  Description of Artificial Sequence: chemically synthesized sequence
QQSYDVVT

SEQ ID NO: 596 - protein, 5 aa, Artificial Sequence
  Description of Artificial Sequence: chemically synthesized sequence
SYWMH

SEQ ID NO: 597 - protein, 17 aa, Artificial Sequence
  Description of Artificial Sequence: chemically synthesized sequence
YINPSSDYNEYSEKFMD

SEQ ID NO: 598 - protein, 13 aa, Artificial Sequence
  Description of Artificial Sequence: chemically synthesized sequence
SGWLVHGDYYFDY

SEQ ID NO: 599 - protein, 17 aa, Artificial Sequence
  Description of Artificial Sequence: chemically synthesized sequence
KSSQSLLHTSTRKNYLA

SEQ ID NO: 600 - protein, 8 aa, Artificial Sequence
  Description of Artificial Sequence: chemically synthesized sequence
KQSYDVVT

SEQ ID NO: 601 - protein, 10 aa, Artificial Sequence
  Description of Artificial Sequence: chemically synthesized sequence
GYIFTSYWMH

SEQ ID NO: 602 - protein, 17 aa, Artificial Sequence
  Description of Artificial Sequence: chemically synthesized sequence
YINPSSGYHEYNQKFID

SEQ ID NO: 603 - protein, 13 aa, Artificial Sequence
  Description of Artificial Sequence: chemically synthesized sequence
SGWLIHGDYYFDF

SEQ ID NO: 604 - protein, 5 aa, Artificial Sequence
  Description of Artificial Sequence: chemically synthesized sequence
SYWIH

SEQ ID NO: 605 - protein, 10 aa, Artificial Sequence
  Description of Artificial Sequence: chemically synthesized sequence
GTTFTSYWIH

SEQ ID NO: 606 - protein, 14 aa, Artificial Sequence
  Description of Artificial Sequence: chemically synthesized sequence
  MOD_RES (4)..(4): Asn or Ser
  MOD_RES (5)..(5): Thr, Arg or Ser
  MOD_RES (9)..(9): Ala or Gly
TGTXXDVGXYNYVS

SEQ ID NO: 607 - protein, 7 aa, Artificial Sequence
  Description of Artificial Sequence: chemically synthesized sequence
  MOD_RES (1)..(1): Glu or Asp
  MOD_RES (3)..(3): Ile, Asn or Asp
  MOD_RES (4)..(4): Asp, His or Asn
XVXXRPS

SEQ ID NO: 608 - protein, 10 aa, Artificial Sequence
  Description of Artificial Sequence: chemically synthesized sequence
  MOD_RES (3)..(3): Phe or Tyr
  MOD_RES (5)..(5): Asn or Ser
  MOD_RES (6)..(6): Arg, Thr or Ser
  MOD_RES (7)..(7): Gly or Ser
  MOD_RES (8)..(8): Ile or Thr
SSXTXXXXRV

SEQ ID NO: 609 - protein, 5 aa, Artificial Sequence
  Description of Artificial Sequence: chemically synthesized sequence
  MOD_RES (1)..(1): Lys, Arg, Thr, Gln, Gly, Ala, Trp, Met, Ile or Ser
  MOD_RES (3)..(3): Val, Arg, Lys, Leu, Met or Ile
  MOD_RES (5)..(5): His, Thr, Asn, Gln, Ala, Val, Tyr, Trp, Phe or Met
XYXMX

SEQ ID NO: 610 - protein, 17 aa, Artificial Sequence
  Description of Artificial Sequence: chemically synthesized sequence
  MOD_RES (8)..(8): Phe or Ile
  MOD_RES (14)..(14): Ser or Thr
SIYPSGGXTFYADXVKG

SEQ ID NO: 611 - protein, 11 aa, Artificial Sequence
  Description of Artificial Sequence: chemically synthesized sequence
  MOD_RES (10)..(10): Glu or Asp
IKLGTVTTVXY

SEQ ID NO: 612 - protein, 14 aa, Artificial Sequence
  Description of Artificial Sequence: chemically synthesized sequence
TGTSSDVGGYNYVS

SEQ ID NO: 613 - protein, 7 aa, Artificial Sequence
  Description of Artificial Sequence: chemically synthesized sequence
DVSNRPS

SEQ ID NO: 614 - protein, 10 aa, Artificial Sequence
  Description of Artificial Sequence: chemically synthesized sequence
SSYTSSSTRV

SEQ ID NO: 615 - protein, 5 aa, Artificial Sequence
  Description of Artificial Sequence: chemically synthesized sequence
SYIMM

SEQ ID NO: 616 - protein, 3 aa, Artificial Sequence
  Description of Artificial Sequence: chemically synthesized sequence
SGQ

SEQ ID NO: 617 - protein, 17 aa, Artificial Sequence
  Description of Artificial Sequence: chemically synthesized sequence
SIYPSGGITFYADTVKG

SEQ ID NO: 618 - protein, 11 aa, Artificial Sequence
  Description of Artificial Sequence: chemically synthesized sequence
IKLGTVTTVDY

SEQ ID NO: 619 - protein, 5 aa, Artificial Sequence
  Description of Artificial Sequence: chemically synthesized sequence
MYMMM

SEQ ID NO: 620 - protein, 17 aa, Artificial Sequence
  Description of Artificial Sequence: chemically synthesized sequence
SIYPSGGITFYADSVKG

SEQ ID NO: 621 - protein, 14 aa, Artificial Sequence
  Description of Artificial Sequence: chemically synthesized sequence
TGTSSDVGAYNYVS

SEQ ID NO: 622 - protein, 17 aa, Artificial Sequence
  Description of Artificial Sequence: chemically synthesized sequence
  MOD_RES (1)..(1): Arg, Ser or Lys
  MOD_RES (2)..(2): Ala or Ser
  MOD_RES (4)..(4): Arg, Asn, Asp, Gln, Glu, His, Lys, Met or Ser
  MISC_FEATURE (5)..(10): This region may or may not be present in its entirety
  MOD_RES (11)..(11): Asn, Asp or Absent
  MOD_RES (12)..(12): Ala, Gln, Glu, Leu, Lys, Met, Pro, Ser, Thr, Tyr or Val
  MOD_RES (13)..(13): Any naturally occurring amino acid
  MOD_RES (14)..(14): Arg, Asn, Ser or Thr
  MOD_RES (15)..(15): Ala, Arg, Asn, Cys, Gln, Glu, His, Ile, Leu, Lys, Met, Phe, Ser, Thr, Tyr or Val
  MOD_RES (16)..(16): Ile, Leu, Met or Val
  MOD_RES (17)..(17): Ala, Arg, Asn, Gln, Glu, His, Ile, Lys, Met, Phe, Ser, Thr or Tyr
XXSXSLLYSSXXXXXXX

SEQ ID NO: 623 - protein, 6 aa, Artificial Sequence
  Description of Artificial Sequence: chemically synthesized sequence
  MOD_RES (1)..(1): Any naturally occurring amino acid
  MOD_RES (2)..(2): Ala, Cys, Gly, Ser, Thr or Val
  MOD_RES (3)..(3): Ala, Cys, His, Ile, Leu, Met, Phe, Ser, Thr, Tyr or Val
  MOD_RES (4)..(4): Arg, Asn, Asp, Gln, Glu, Lys, Ser or Thr
  MOD_RES (5)..(5): Ala, Arg, Asn, Asp, Gln, Glu, Gly, His, Lys, Met, Phe, Pro, Ser, Thr or Tyr
  MOD_RES (6)..(6): Ala, Asn, Ser or Thr
XXXXXX

SEQ ID NO: 624 - protein, 9 aa, Artificial Sequence
  Description of Artificial Sequence: chemically synthesized sequence
  MOD_RES (1)..(1): Arg, Asn, Gln, Glu or His
  MOD_RES (3)..(3): Any naturally occurring amino acid
  MOD_RES (4)..(4): Ala, Arg, Asn, Cys, Gln, Glu, His, Ile, Leu, Lys, Met, Phe, Ser, Thr, Tyr or Val
  MOD_RES (5)..(5): Asn, Gly or Ser
  MOD_RES (6)..(6): Ala, Arg, Asn, Asp, Cys, Gln, Glu, Gly, His, Ile, Leu, Lys, Met, Phe, Arg, Ser, Thr, Trp, Tyr or Val
  MOD_RES (8)..(8): Ala, Arg, Asn, Asp, Gln, Glu, Gly, His, Lys, Met, Pro, Ser, Thr or Tyr
XQXXXXPXT

SEQ ID NO: 625 - protein, 10 aa, Artificial Sequence
  Description of Artificial Sequence: chemically synthesized sequence
  MOD_RES (2)..(2): Tyr or Phe
  MOD_RES (3)..(3): Thr or Ser
  MOD_RES (4)..(4): Ile, Leu, Met or Phe
  MOD_RES (5)..(5): Ala, Arg, Asn, Asp, Cys, Gln, Glu, His, Ile, Leu, Lys, Met, Pro, Ser, Thr, Trp, Tyr or Val
  MOD_RES (6)..(6): Asn, Asp, Gln, Glu, Lys, Pro, Ser or Thr
  MOD_RES (7)..(7): Ala, Arg, Asn, Asp, Cys, Gln, Glu, Gly, His, Ile, Leu, Lys, Met, Phe, Pro, Ser, Thr, Tyr or Val
  MOD_RES (8)..(8): Ala, Arg, Asn, Asp, Cys, Gln, Glu, Gly, His, Ile, Leu, Lys, Met, Phe, Pro, Ser, Thr, Tyr or Val
  MOD_RES (9)..(9): Ala, Arg, Cys, Gln, Glu, His, Ile, Leu, Lys, Met, Phe, Ser, Thr, Trp, Tyr or Val
GXXXXXXXXN

SEQ ID NO: 626 - protein, 17 aa, Artificial Sequence
  Description of Artificial Sequence: chemically synthesized sequence
  MOD_RES (1)..(1): Any naturally occurring amino acid
  MOD_RES (2)..(2): Ile, Leu, Met, Phe or Val
  MOD_RES (3)..(3): Any naturally occurring amino acid
  MISC_FEATURE (4)..(4): May or may not be present
  MOD_RES (5)..(5): Ala, Arg, Asn, Gln, Glu, His, Lys, Met, Ser, Thr, Tyr or Val
  MOD_RES (6)..(6): Ala, Arg, Asn, Asp, Cys, Gln, Glu, Gly, His, Lys, Met, Phe, Pro, Ser, Thr, Tyr or Val
  MOD_RES (7)..(7): Asn, Gly or Ser
  MOD_RES (8)..(8): Asn, Gly or Ser
  MOD_RES (10)..(10): Ala, Arg, Asn, Gln, Glu, His, Lys, Met, Ser, Thr or Tyr
  MOD_RES (11)..(11): Ala, Arg, Asn, Cys, Gln, Glu, His, Ile, Leu, Lys, Met, Phe, Ser, Thr, Trp, Tyr or Val
  MOD_RES (13)..(13): Ala, Asp, Gln, Glu, Lys, Pro, Ser or Thr
  MOD_RES (14)..(14): Ala, Arg, Asn, Asp, Cys, Gln, Glu, Gly, His, Ile, Leu, Lys, Met, Phe, Pro, Ser, Thr, Tyr or Val
  MOD_RES (15)..(15): Ile, Leu, Met or Phe
  MOD_RES (17)..(17): Ala, Gly or Ser
XXXPXXXXTXXNXXXKX

SEQ ID NO: 627 - protein, 10 aa, Artificial Sequence
  Description of Artificial Sequence: chemically synthesized sequence
  MOD_RES (1)..(1): Ala, Arg, Asn, Gln, Glu, His, Lys, Met, Ser, Thr or Tyr
  MOD_RES (2)..(2): Ala, Arg, Asn, Asp, Cys, Gln, Glu, Gly, His, Lys, Met, Phe, Pro, Ser, Thr, Tyr or Val
  MOD_RES (3)..(3): Gln, Gly, His, Thr or Trp
  MOD_RES (4)..(7): Any naturally occurring amino acid
  MOD_RES (8)..(8): Phe or Tyr
  MISC_FEATURE (9)..(10): This region may or may not be present in its entirety
XXXXXXXXAI

SEQ ID NO: 628 - protein, 10 aa, Artificial Sequence
  Description of Artificial Sequence: chemically synthesized sequence
RASSSVSYIY

SEQ ID NO: 629 - protein, 7 aa, Artificial Sequence
  Description of Artificial Sequence: chemically synthesized sequence
ATFNLAS

SEQ ID NO: 630 - protein, 9 aa, Artificial Sequence
  Description of Artificial Sequence: chemically synthesized sequence
HQRSSYPWT

SEQ ID NO: 631 - protein, 10 aa, Artificial Sequence
  Description of Artificial Sequence: chemically synthesized sequence
GYTFPDYYMN

SEQ ID NO: 632 - protein, 17 aa, Artificial Sequence
  Description of Artificial Sequence: chemically synthesized sequence
DIDPNYGGTTYNQKFKG

SEQ ID NO: 633 - protein, 3 aa, Artificial Sequence
  Description of Artificial Sequence: chemically synthesized sequence
GAL

SEQ ID NO: 634 - protein, 10 aa, Artificial Sequence
  Description of Artificial Sequence: chemically synthesized sequence
SASSSIRYMH

SEQ ID NO: 635 - protein, 7 aa, Artificial Sequence
  Description of Artificial Sequence: chemically synthesized sequence
DTSKLTS

SEQ ID NO: 636 - protein, 9 aa, Artificial Sequence
  Description of Artificial Sequence: chemically synthesized sequence
QQDSSYPLT

SEQ ID NO: 637 - protein, 10 aa, Artificial Sequence
  Description of Artificial Sequence: chemically synthesized sequence
GYTFTSYDIN

SEQ ID NO: 638 - protein, 17 aa, Artificial Sequence
  Description of Artificial Sequence: chemically synthesized sequence
WIFPRDNNTKYNENFKG

SEQ ID NO: 639 - protein, 7 aa, Artificial Sequence
  Description of Artificial Sequence: chemically synthesized sequence
ENWVGDF

SEQ ID NO: 640 - protein, 11 aa, Artificial Sequence
  Description of Artificial Sequence: chemically synthesized sequence
KASQDVGTAVA

SEQ ID NO: 641 - protein, 7 aa, Artificial Sequence
  Description of Artificial Sequence: chemically synthesized sequence
WASTRHT

SEQ ID NO: 642 - protein, 9 aa, Artificial Sequence
  Description of Artificial Sequence: chemically synthesized sequence
QQYYGYPLT

SEQ ID NO: 643 - protein, 10 aa, Artificial Sequence
  Description of Artificial Sequence: chemically synthesized sequence
GYSITSDYWN

SEQ ID NO: 644 - protein, 16 aa, Artificial Sequence
  Description of Artificial Sequence: chemically synthesized sequence
YISYTGSTYYNPSLKS

SEQ ID NO: 645 - protein, 8 aa, Artificial Sequence
  Description of Artificial Sequence: chemically synthesized sequence
YGGWLSPF

SEQ ID NO: 646 - protein, 16 aa, Artificial Sequence
  Description of Artificial Sequence: chemically synthesized sequence
KSSQSLLYSSNQKNSL

SEQ ID NO: 647 - protein, 10 aa, Artificial Sequence
  Description of Artificial Sequence: chemically synthesized sequence
GYSIISDYWN

SEQ ID NO: 648 - protein, 8 aa, Artificial Sequence
  Description of Artificial Sequence: chemically synthesized sequence
RGGWLLPF

SEQ ID NO: 649 - protein, 10 aa, Artificial Sequence
  Description of Artificial Sequence: chemically synthesized sequence
GFSLTTYSIN

SEQ ID NO: 650 - protein, 16 aa, Artificial Sequence
  Description of Artificial Sequence: chemically synthesized sequence
VMWAGGGTNSNSVLKS

SEQ ID NO: 651 - protein, 10 aa, Artificial Sequence
  Description of Artificial Sequence: chemically synthesized sequence
YYGNSPYYAI

SEQ ID NO: 652 - protein, 13 aa, Artificial Sequence
  Description of Artificial Sequence: chemically synthesized sequence
TRSSGSIGSNYVQ

SEQ ID NO: 653 - protein, 7 aa, Artificial Sequence
  Description of Artificial Sequence: chemically synthesized sequence
EDNQRPS

SEQ ID NO: 654 - protein, 9 aa, Artificial Sequence
  Description of Artificial Sequence: chemically synthesized sequence
QSYDSSTWV

SEQ ID NO: 655 - protein, 17 aa, Artificial Sequence
  Description of Artificial Sequence: chemically synthesized sequence
WISPIGGSTNYAQKVQG

SEQ ID NO: 656 - protein, 19 aa, Artificial Sequence
  Description of Artificial Sequence: chemically synthesized sequence
  MOD_RES (3)..(17): Any naturally occurring amino acid
GLXXXXXXXXXXXXXXXDV

SEQ ID NO: 657 - protein, 13 aa, Artificial Sequence
  Description of Artificial Sequence: chemically synthesized sequence
TRSSGNIASNYVQ

SEQ ID NO: 658 - protein, 7 aa, Artificial Sequence
  Description of Artificial Sequence: chemically synthesized sequence
GKNNRPS

SEQ ID NO: 659 - protein, 10 aa, Artificial Sequence
  Description of Artificial Sequence: chemically synthesized sequence
QSYDSSNLWV

SEQ ID NO: 660 - protein, 5 aa, Artificial Sequence
  Description of Artificial Sequence: chemically synthesized sequence
SYGIS

SEQ ID NO: 661 - protein, 17 aa, Artificial Sequence
  Description of Artificial Sequence: chemically synthesized sequence
WISAYNGNTNYAQKLED

SEQ ID NO: 662 - protein, 15 aa, Artificial Sequence
  Description of Artificial Sequence: chemically synthesized sequence
ALPSGTILVGGWFDP

SEQ ID NO: 663 - protein, 11 aa, Artificial Sequence
  Description of Artificial Sequence: chemically synthesized sequence
QGDSLRSYYAS

SEQ ID NO: 664 - protein, 7 aa, Artificial Sequence
  Description of Artificial Sequence: chemically synthesized sequence
SDRDRPS

SEQ ID NO: 665 - protein, 11 aa, Artificial Sequence
  Description of Artificial Sequence: chemically synthesized sequence
NSRDSSGNHYV

SEQ ID NO: 666 - protein, 5 aa, Artificial Sequence
  Description of Artificial Sequence: chemically synthesized sequence
SYALS

SEQ ID NO: 667 - protein, 17 aa, Artificial Sequence
  Description of Artificial Sequence: chemically synthesized sequence
AISGGGGSTYYADSVKD

SEQ ID NO: 668 - protein, 15 aa, Artificial Sequence
  Description of Artificial Sequence: chemically synthesized sequence
DVFPETFSMNYGMDV

SEQ ID NO: 669 - protein, 11 aa, Artificial Sequence
  Description of Artificial Sequence: chemically synthesized sequence
GGSDIGRKSVH

SEQ ID NO: 670 - protein, 11 aa, Artificial Sequence
  Description of Artificial Sequence: chemically synthesized sequence
QVWDNNSDHYV

SEQ ID NO: 671 - protein, 5 aa, Artificial Sequence
  Description of Artificial Sequence: chemically synthesized sequence
DYAMH

SEQ ID NO: 672 - protein, 17 aa, Artificial Sequence
  Description of Artificial Sequence: chemically synthesized sequence
LISGDGGSTYYADSVKD

SEQ ID NO: 673 - protein, 19 aa, Artificial Sequence
  Description of Artificial Sequence: chemically synthesized sequence
VLLPCSSTSCYGSVGAFDI

SEQ ID NO: 674 - protein, 9 aa, Artificial Sequence
  Description of Artificial Sequence: chemically synthesized sequence
SSYTSSTLP

SEQ ID NO: 675 - protein, 5 aa, Artificial Sequence
  Description of Artificial Sequence: chemically synthesized sequence
NYDMS

SEQ ID NO: 676 - protein, 17 aa, Artificial Sequence
  Description of Artificial Sequence: chemically synthesized sequence
RVNWNGGSTTYADAVKD

SEQ ID NO: 677 - protein, 8 aa, Artificial Sequence
  Description of Artificial Sequence: chemically synthesized sequence
EFVGAYDL

SEQ ID NO: 678 - protein, 11 aa, Artificial Sequence
  Description of Artificial Sequence: chemically synthesized sequence
RASQSIGNSLA

SEQ ID NO: 679 - protein, 7 aa, Artificial Sequence
  Description of Artificial Sequence: chemically synthesized sequence
AASTLQS

SEQ ID NO: 680 - protein, 9 aa, Artificial Sequence
  Description of Artificial Sequence: chemically synthesized sequence
QQHTIPTFS

SEQ ID NO: 681 - protein, 5 aa, Artificial Sequence
  Description of Artificial Sequence: chemically synthesized sequence
GLYIH

SEQ ID NO: 682 - protein, 17 aa, Artificial Sequence
  Description of Artificial Sequence: chemically synthesized sequence
WIIPIFGTANYAQKFED

SEQ ID NO: 683 - protein, 12 aa, Artificial Sequence
  Description of Artificial Sequence: chemically synthesized sequence
GLRWGIWGWFDP

SEQ ID NO: 684 - protein, 11 aa, Artificial Sequence
  Description of Artificial Sequence: chemically synthesized sequence
RASQGIGSYLA

SEQ ID NO: 685 - protein, 7 aa, Artificial Sequence
  Description of Artificial Sequence: chemically synthesized sequence
QDIKRPS

SEQ ID NO: 686 - protein, 9 aa, Artificial Sequence
  Description of Artificial Sequence: chemically synthesized sequence
QQLNNYPIT

SEQ ID NO: 687 - protein, 5 aa, Artificial Sequence
  Description of Artificial Sequence: chemically synthesized sequence
DNAIS

SEQ ID NO: 688 - protein, 17 aa, Artificial Sequence
  Description of Artificial Sequence: chemically synthesized sequence
WIIPIFGKPNYAQKFED

SEQ ID NO: 689 - protein, 12 aa, Artificial Sequence
  Description of Artificial Sequence: chemically synthesized sequence
TMVRGFLGVMDV

SEQ ID NO: 690 - protein, 11 aa, Artificial Sequence
  Description of Artificial Sequence: chemically synthesized sequence
SGDKLGNKYAY

SEQ ID NO: 691 - protein, 7 aa, Artificial Sequence
  Description of Artificial Sequence: chemically synthesized sequence
EDYRRPS

SEQ ID NO: 692 - protein, 8 aa, Artificial Sequence
  Description of Artificial Sequence: chemically synthesized sequence
QTWDNSVV

SEQ ID NO: 693 - protein, 17 aa, Artificial Sequence
  Description of Artificial Sequence: chemically synthesized sequence
AISGSGGSTYYADSVKD

SEQ ID NO: 694 - protein, 16 aa, Artificial Sequence
  Description of Artificial Sequence: chemically synthesized sequence
DQFVTIFGVPRYGMDV

SEQ ID NO: 695 - protein, 13 aa, Artificial Sequence
  Description of Artificial Sequence: chemically synthesized sequence
TRSSGSIDSNYVQ

SEQ ID NO: 696 - protein, 7 aa, Artificial Sequence
  Description of Artificial Sequence: chemically synthesized sequence
DDSDRPS

SEQ ID NO: 697 - protein, 11 aa, Artificial Sequence
  Description of Artificial Sequence: chemically synthesized sequence
QSYDSNNRHVI

SEQ ID NO: 698 - protein, 5 aa, Artificial Sequence
  Description of Artificial Sequence: chemically synthesized sequence
TYALN

SEQ ID NO: 699 - protein, 17 aa, Artificial Sequence
  Description of Artificial Sequence: chemically synthesized sequence
RIVPLIGLVNYAHNFED

SEQ ID NO: 700 - protein, 11 aa, Artificial Sequence
  Description of Artificial Sequence: chemically synthesized sequence
GRQMFGAGIDF

SEQ ID NO: 701 - protein, 13 aa, Artificial Sequence
  Description of Artificial Sequence: chemically synthesized sequence
TRSSGNIGTNYVQ

SEQ ID NO: 702 - protein, 7 aa, Artificial Sequence
  Description of Artificial Sequence: chemically synthesized sequence
EDNKRPS

SEQ ID NO: 703 - protein, 9 aa, Artificial Sequence
  Description of Artificial Sequence: chemically synthesized sequence
QSYHSSGWE

SEQ ID NO: 704 - protein, 5 aa, Artificial Sequence
  Description of Artificial Sequence: chemically synthesized sequence
SHGIT

SEQ ID NO: 705 - protein, 17 aa, Artificial Sequence
  Description of Artificial Sequence: chemically synthesized sequence
WISAHNGHASNAQKVED

SEQ ID NO: 706 - protein, 9 aa, Artificial Sequence
  Description of Artificial Sequence: chemically synthesized sequence
EVYGGNSDY

SEQ ID NO: 707 - protein, 11 aa, Artificial Sequence
  Description of Artificial Sequence: chemically synthesized sequence
GGNNIGSKGVH

SEQ ID NO: 708 - protein, 11 aa, Artificial Sequence
  Description of Artificial Sequence: chemically synthesized sequence
YKSDSNKQQAS

SEQ ID NO: 709 - protein, 11 aa, Artificial Sequence
  Description of Artificial Sequence: chemically synthesized sequence
QVWDSSSDHWV

SEQ ID NO: 710 - protein, 5 aa, Artificial Sequence
  Description of Artificial Sequence: chemically synthesized sequence
RHGMH

SEQ ID NO: 711 - protein, 17 aa, Artificial Sequence
  Description of Artificial Sequence: chemically synthesized sequence
VISHDGSVKYYADSMKD

SEQ ID NO: 712 - protein, 11 aa, Artificial Sequence
  Description of Artificial Sequence: chemically synthesized sequence
VHAALYYGMDV

SEQ ID NO: 713 - protein, 13 aa, Artificial Sequence
  Description of Artificial Sequence: chemically synthesized sequence
TRSSGSIASNYVQ

SEQ ID NO: 714 - protein, 10 aa, Artificial Sequence
  Description of Artificial Sequence: chemically synthesized sequence
QSYDSTTPSV

SEQ ID NO: 715 - protein, 17 aa, Artificial Sequence
  Description of Artificial Sequence: chemically synthesized sequence
WTSPHNGLTAFAQILED

SEQ ID NO: 716 - protein, 12 aa, Artificial Sequence
  Description of Artificial Sequence: chemically synthesized sequence
GLSYQVSGWFDP

SEQ ID NO: 717 - protein, 13 aa, Artificial Sequence
  Description of Artificial Sequence: chemically synthesized sequence
TRSSGSIASHYVQ

SEQ ID NO: 718 - protein, 9 aa, Artificial Sequence
  Description of Artificial Sequence: chemically synthesized sequence
QSYDGITVI

SEQ ID NO: 719 - protein, 17 aa, Artificial Sequence
  Description of Artificial Sequence: chemically synthesized sequence
RIIPILGIANYAQKFED

SEQ ID NO: 720 - protein, 11 aa, Artificial Sequence
  Description of Artificial Sequence: chemically synthesized sequence
VHPVFSYALDV

SEQ ID NO: 721 - protein, 14 aa, Artificial Sequence
  Description of Artificial Sequence: chemically synthesized sequence
TLRSGLNVGSYRIY

SEQ ID NO: 722 - protein, 10 aa, Artificial Sequence
  Description of Artificial Sequence: chemically synthesized sequence
QSYDSSNRWV

SEQ ID NO: 723 - protein, 5 aa, Artificial Sequence
  Description of Artificial Sequence: chemically synthesized sequence
TYAFS

SEQ ID NO: 724 - protein, 17 aa, Artificial Sequence
  Description of Artificial Sequence: chemically synthesized sequence
WISAYNGNTNYAQKVED

SEQ ID NO: 725 - protein, 9 aa, Artificial Sequence
  Description of Artificial Sequence: chemically synthesized sequence
DGYGSDPVL

SEQ ID NO: 726 - protein, 9 aa, Artificial Sequence
  Description of Artificial Sequence: chemically synthesized sequence
MIWYSSAVV

SEQ ID NO: 727 - protein, 5 aa, Artificial Sequence
  Description of Artificial Sequence: chemically synthesized sequence
NYGIS

SEQ ID NO: 728 - protein, 9 aa, Artificial Sequence
  Description of Artificial Sequence: chemically synthesized sequence
GDFRKPFDY

SEQ ID NO: 729 - protein, 15 aa, Artificial Sequence
  Description of Artificial Sequence: chemically synthesized sequence
RATESVEYYGTSLVQ

SEQ ID NO: 730 - protein, 7 aa, Artificial Sequence
  Description of Artificial Sequence: chemically synthesized sequence
AASSVDS

SEQ ID NO: 731 - protein, 9 aa, Artificial Sequence
  Description of Artificial Sequence: chemically synthesized sequence
QQSRRVPYT

SEQ ID NO: 732 - protein, 5 aa, Artificial Sequence
  Description of Artificial Sequence: chemically synthesized sequence
SYVMH

SEQ ID NO: 733 - protein, 17 aa, Artificial Sequence
  Description of Artificial Sequence: chemically synthesized sequence
YVNPFNDGTKYNEMFKG

SEQ ID NO: 734 - protein, 6 aa, Artificial Sequence
  Description of Artificial Sequence: chemically synthesized sequence
QAWGYP

SEQ ID NO: 735 - protein, 122 aa, Artificial Sequence
  Description of Artificial Sequence: chemically synthesized sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTK

SEQ ID NO: 736 - protein, 118 aa, Artificial Sequence [sequence omitted]

SEQ ID NO: 737 - protein, 447 aa, Artificial Sequence
  Description of Artificial Sequence: chemically synthesized sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 738 - protein, 214 aa, Artificial Sequence
  Description of Artificial Sequence: chemically synthesized sequence
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 739 - protein, 121 aa, Artificial Sequence
  Description of Artificial Sequence: chemically synthesized sequence
EVQLVESGGGLVQPGGSLRLSCAASGFTFSRFWMSWVRQAPGKGLEWVANINQDGTEKYYVDSVKGRFTISRDNAKNSLYLQMNSLRAGDTAVYYCANTYYDFWSGHFDYWGQGTLVTVSS

SEQ ID NO: 740 - protein, 121 aa, Artificial Sequence
  Description of Artificial Sequence: chemically synthesized sequence
QEHLVESGGGVVQPGRSLRLSCEASGFTFSNFGMHWVRQAPGKGLEWVAALWSDGSNKYYADSVKGRVTISRDNSKNTLYLQMNSLRAEDTAVYYCARGRGAPGIPIFGYWGQGTLVTVSS

SEQ ID NO: 741 - protein, 130 aa, Artificial Sequence
  Description of Artificial Sequence: chemically synthesized sequence
EVQLVESGGGLVKPGGSLRLSCAASGFTFSNAWMSWVRQAPGKGLEWVGRIKRKTDGGTTDYAAPVKGRFTISRDDSKNTLHLQMNSLKTEDTAVYYCTTDDIVVVPAVMREYYFGMDVWGQGTTVTVSS

SEQ ID NO: 742 - protein, 121 aa, Artificial Sequence
  Description of Artificial Sequence: chemically synthesized sequence
QVQLVQSGAEVKKPGASVQVSCKASGYSFTGYYIHWVRQAPGQGLEWMGWINPNSGTKKYAHKFQGRVTMTRDTSIDTAYMILSSLISDDTAVYYCARDEDWNFGSWFDSWGQGTLVTVSS

SEQ ID NO: 743 - protein, 121 aa, Artificial Sequence
  Description of Artificial Sequence: chemically synthesized sequence
QVHLVQSGAEVKKPGASVKVSCKASGYTFTGYYIHWVRQAPGHGLEWMGWLNPNTGTTKYIQNFQGRVTMTRDTSSSTAYMELTRLRSDDTAVYYCARDEDWNYGSWFDTWGQGTLVTVSS

SEQ ID NO: 744 - protein, 120 aa, Artificial Sequence
  Description of Artificial Sequence: chemically synthesized sequence
EVQLVESGGGVVRPGGSLRLSCAASGFTFDDYGMTWVRQAPGRGLEWVSGIHWHGKRTGYADSVKGRFTISRDNAKKSLYLQMNSLKGEDTALYHCVRGGMSTGDWFDPWGQGTLVIVSS

SEQ ID NO: 745 - protein, 120 aa, Artificial Sequence
  Description of Artificial Sequence: chemically synthesized sequence
EVQLVESGGGVVRPGGSLRLSCAASGFTFDDYGMTWVRQVPGKGLEWVSGIHWSGRSTGYADSVKGRFTISRDNAKNSLYLQMNSLRAEDTALYYCARGGMSTGDWFDPWGQGTLVTVSS

SEQ ID NO: 746 - protein, 115 aa, Artificial Sequence
  Description of Artificial Sequence: chemically synthesized sequence
EVQLVESGGGLVQPGGSLRLSCAASGFTVGSNYMNWVRQAPGKGLEWVSVIYSGGSTYYADSVKGRFTISRLTSKNTLYLQMSSLRPEDTAVYYCARGIRGLDVWGQGTTVTVSS

SEQ ID NO: 747 - protein, 115 aa, Artificial Sequence
  Description of Artificial Sequence: chemically synthesized sequence
EERLVESGGDLVQPGGSLRLSCAASGITVGTNYMNWVRQAPGKGLEWVSVISSGGNTHYADSVKGRFIMSRQTSKNTLYLQMNSLETEDTAVYYCARGIRGLDVWGQGTMVTVSS

SEQ ID NO: 748 - protein, 118 aa, Artificial Sequence
  Description of Artificial Sequence: chemically synthesized sequence
QVQLVQSGAEVKMPGSSVRVSCKASGGIFSSSTISWVRQAPGQGLEWMGEIIPVFGTVNYAQKFQDRVIFTADESTTTAYMELSSLKSGDTAVYFCARNWGLGSFYIWGQGTMVTVSS

SEQ ID NO: 749 - protein, 115 aa, Artificial Sequence
  Description of Artificial Sequence: chemically synthesized sequence
EVQLVESGGDLVHPGRSLRLSCAASGFPFDEYAMHWVRQVPGKGLEWVSGISWSNNNIGYADSVKGRFTISRDNAKNSLYLQMNSLRPEDTAFYYCAKSGIFDSWGQGTLVTVSS

SEQ ID NO: 750 - protein, 118 aa, Artificial Sequence
  Description of Artificial Sequence: chemically synthesized sequence
EVQLVESGGGVVQPGRSLRLSCAASGFTFSSYGMHWVRQAPGKGLEWVTLISYEGRNKYYADSVKGRFTISRDNSKNTLYLQMNSLRAEDTAVYYCAKDRTLYGMDVWGQGTTVTVSS

SEQ ID NO: 751 - protein, 121 aa, Artificial Sequence
  Description of Artificial Sequence: chemically synthesized sequence
QVTLRESGPALVKTTQTLTLTCTFSGFSLSTNRMCVTWIRQPPGKALEWLARIDWDGVKYYNTSLKTRLTISKDTSKNQVVLTMTNMDPVDTATFYCARSTSLTFYYFDYWGQGTLVTVSS

SEQ ID NO: 752 - protein, 115 aa, Artificial Sequence
  Description of Artificial Sequence: chemically synthesized sequence
EVQLVESGGGLVQPGGSLRLSCAASEFTVGTNHMNWVRQAPGKGLEWVSVIYSGGNTFYADSVKGRFTISRHTSKNTLYLQMNSLTAEDTAVYYCARGLGGMDVWGQGTTVTVSS

SEQ ID NO: 753 - protein, 120 aa, Artificial Sequence
  Description of Artificial Sequence: chemically synthesized sequence
EVQLVESGGGLVQRGESLRLYCAASGFTFSKYWMNWVRQAPGKGLEWVANIKGDGSEKYYVDSVKGRFTISRDNAKNSLYLQMNSLRAEDTAVYYCARDYWGSGYYFDFWGQGTLVTVSS

SEQ ID NO: 754 - protein, 130 aa, Artificial Sequence
  Description of Artificial Sequence: chemically synthesized sequence
EVQLVESGGGLVQSGGSLRLSCAASGFTFSSYWMSWVRQAPGKGLEWVANIKQDGSEKYYVDSVKGRFTISRDNAKNSLYLQMNSLRADDTAVYYCARDDIVVVPAPMGYYYYYFGMDVWGQGTTVTVSS

SEQ ID NO: 755 - protein, 123 aa, Artificial Sequence
  Description of Artificial Sequence: chemically synthesized sequence
EVQLVESGGGLVQPGRSLRLSCAASGFTFDDFAMHWVRQAPGKGLEWVSGISWTGGNMDYANSVKGRFTISREDAKNSLYLQMNSLRAADTALYYCVKDIRGIVATGGAFDIWGRGTMVTVSS

SEQ ID NO: 756 - protein, 115 aa, Artificial Sequence
  Description of Artificial Sequence: chemically synthesized sequence
EVQLVESGGGLVQPGGSLRLSCAASGFTVGTNYMNWVRQAPGKGLEWISVIYSGGSTFYADSVKGRFTISRQTSQNTLYLQMNSLRPEDTAVYYCARGIRGFDIWGQGTMVTVSS

SEQ ID NO: 757 - protein, 115 aa, Artificial Sequence
  Description of Artificial Sequence: chemically synthesized sequence
EVQLVESGGGLVQPGGSLRLSCAASGFTISTNYMNWVRQAPGKGLEWVAVIYSSGSTYYIDSVKGRFTISRLTSKNTVYLQMSSLNSEDTAVYYCARGIRGFDIWGQGTMVTVSS

SEQ ID NO: 758 - protein, 124 aa, Artificial Sequence
  Description of Artificial Sequence: chemically synthesized sequence
EVQLVESGGGLVQPGRSLRLSCAASGFTIDDSAMHWVRQTPGKGLEWVSGISWKSGSIGYADSVRGRFTISRDNAKNSLYLQMNSLRVEDTALYYCVKDIRGNWNYGGNWFDPWGQGTLVTVSS

SEQ ID NO: 759 - protein, 115 aa, Artificial Sequence
  Description of Artificial Sequence: chemically synthesized sequence
EVQLVESGGGLVQPGGSLRLSCEASGFTVGVNHMNWVRQAPGKGLEWVSVIFSSGRTFYGDYVKGRLTIFRQTSQNTVYLQMNSLRSEDTAIYYCARGIGGLDIWGRGTMVTVSS

SEQ ID NO: 760 - protein, 123 aa, Artificial Sequence
  Description of Artificial Sequence: chemically synthesized sequence
EVQLVESGGGLVQPGRSLRLSCAASGFTFDDYALHWVRQAPGKGLEWVSGISWTGGTIDYADSVKGRFTISRDNAKNSLYLQMSSLRTEDTAIYYCTRDIRGNWKYGGWFDPWGQGTLVTVSS

SEQ ID NO: 761 - protein, 120 aa, Artificial Sequence
  Description of Artificial Sequence: chemically synthesized sequence
QVQLVQSGTEVKKPGASVKVSCKASGYTFTAYYMHWVRQAPGQGLDWMGWISPNSGFTNYAQKFQGRVTMTRDTSINTFYMELSGLRSDDTAVYYCAREGSTHHNSFDPWGQGTLVTVSS

SEQ ID NO: 762 - protein, 114 aa, Artificial Sequence
  Description of Artificial Sequence: chemically synthesized sequence
EVQLVESGGGLVQPGGSLRLSCAASGFTVGTNFMNWVRQAPGKGLEWVSAIYSGGTANYADSVKGRFTISRDTSRNTLYLQMNSLRTEDTAVYYCARGGGMDVWGQGTTVTVSS

SEQ ID NO: 763 - protein, 118 aa, Artificial Sequence
  Description of Artificial Sequence: chemically synthesized sequence
QVQLVQSGAEVKKPGSSVKVSCKASGGTFNTYVLSWVRQAPGQGLEWMGEIIPILGAANYAQNFQGRVTFTTDESTNTAYMDLSSLRSEDTAVYYCARDRTSGGFDPWGQGTLVTVSS

SEQ ID NO: 764 - protein, 119 aa, Artificial Sequence
  Description of Artificial Sequence: chemically synthesized sequence
QVQLVQSGAEVEKPGASVKVSCKASGYIFTHYGISWVRQAPGQGLEWVGWISPYNGYTDYAQKLQGRVTLTTDTSTTTAYMELRNLRSDDTAMYYCSRGRGPYWSFDLWGRGTLVTVSS

SEQ ID NO: 765 - protein, 106 aa, Artificial Sequence
  Description of Artificial Sequence: chemically synthesized sequence
DIQMTQSPSTLSASVGDRVTITCRASQSISNWLAWYQQKPGKAPKLLIYKASSLESGVPSRFSGSGSGTEFTLTISSLQPDDFATYYCQQYHSYSYTFGQGTKEIK

SEQ ID NO: 766 - protein, 107 aa, Artificial Sequence
  Description of Artificial Sequence: chemically synthesized sequence
DIQMTQSPSSLSASVGDRVTITCRASQGIRNDLGWYQQKPGKAPKRLIYTASSLQSGVPSRFSGSGSGTEFTLTISSLQPEDFATYYCLQHNSYPLTFGGGTKVAIK

SEQ ID NO: 767 - protein, 107 aa, Artificial Sequence
  Description of Artificial Sequence: chemically synthesized sequence
DIQMTQSPSSLSASVGDRVTITCRTSQGIRNDLGWYQQKPGKAPKRLIYAASSLQSGVPSRFSGSGSGTEFTLTISSLQPEDFATYYCLQHNNYPYTFGQGTKLEIK

SEQ ID NO: 768 - protein, 112 aa, Artificial Sequence
  Description of Artificial Sequence: chemically synthesized sequence
DIVMTQTPLSSPVTLGQPASISCRSSQTLVHGDGNTYLSWIQQRPGQPPRLLIYKVSNQFSGVPDRFSGSGAGTDFTLKISRVEAEDVGLYFCMQATHFPITFGQGTRLEIK

SEQ ID NO: 769 - protein, 112 aa, Artificial Sequence
  Description of Artificial Sequence: chemically synthesized sequence
DIVMTQTPLSSPVTLGQPASISCRSSPSLVHSDGNTYLSWLQQRPGQPPRLLIYKISNRFSGVPDRFSGSGAGTDFTLKISRVEAEDVGVYYCMQATHFPITFGQGTRLEIR

SEQ ID NO: 770 - protein, 108 aa, Artificial Sequence
  Description of Artificial Sequence: chemically synthesized sequence
DIQMTQSPSSLSASLGDRVTITCRASQSINSYLNWYQQKPGKAPKLLIYVASSLQSGVPSRFSGSGSGTEFTLTISNLQPEDFATYYCQQSYSTPPITFGQGTRLEIK

SEQ ID NO: 771 - protein, 108 aa, Artificial Sequence
  Description of Artificial Sequence: chemically synthesized sequence
DIQMTQSPSSLSASVGDRVTITCRASQSISSYLNWYQQKPGKAPKLLIYVASSLQSGVPSRFSGSGSGTDFTLTISSLQPEDFATYYCQQSYSTPPITFGQGTRLEIK

SEQ ID NO: 772 - protein, 108 aa, Artificial Sequence
  Description of Artificial Sequence: chemically synthesized sequence
DIQMTQSPSSLSASVGDRVTITCRASQTINIYLNWYQQKPGRAPRLLIYAASSLQSGVPSRFSGSGSGTDFTLTISSLQPEDFATYYCHQSYSTPPITFGQGTRLEIK

SEQ ID NO: 773 - protein, 108 aa, Artificial Sequence
  Description of Artificial Sequence: chemically synthesized sequence
DIQMTQSPSSLSASVGDRVTITCRASQSMSSYLNWYQQKPGRAPKLLIFAASSLQSGVPSRFSGSGSGTDFTLTISSLQPEDFATYYCQQSYSTPPITFGQGTRLEIK

SEQ ID NO: 774 - protein, 108 aa, Artificial Sequence
  Description of Artificial Sequence: chemically synthesized sequence
EIVLTQSPGTLSLSPGERATLSCRASQSFNFNYLAWYQQKPGQAPRLLIYGASSRATGIPDRFSGSGSGTDFTLTINRLEPEDFGVFYCQQYESAPWTFGQGTKVEIK

SEQ ID NO: 775 - protein, 105 aa, Artificial Sequence
  Description of Artificial Sequence: chemically synthesized sequence
DIQMTQSPSSLSASVGDRVTITCRASQSISSYLNWYQQKPGKLLIYAASSLQSGVPSRFSGGGSGTDFTLTISSLRPEDFATYYCQQSYCTPPITFGQGTRLEIK

SEQ ID NO: 776 - protein, 108 aa, Artificial Sequence
  Description of Artificial Sequence: chemically synthesized sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 777 - protein, 91 aa, Artificial Sequence
  Description of Artificial Sequence: chemically synthesized sequence
DRVTITCRASQVISNYLAWYQQKPGKVPRLLIYAASTLQSGVPSRFSGSGSGTDFTLTISSLQPEDVATYYCQKYNSAPRTFGQGTKVEIK

SEQ ID NO: 778 - protein, 107 aa, Artificial Sequence
  Description of Artificial Sequence: chemically synthesized sequence
DIQMTQSPSSLSASVGDRVTITCRASQNINNYLNWYQQKPGKAPKLLIYAASSFQNAVPSRFSGSGSGTDFTLTISSLQPEDFATYYCQQSYNTPLTFGGGTKVEIK

SEQ ID NO: 779 - protein, 107 aa, Artificial Sequence
  Description of Artificial Sequence: chemically synthesized sequence
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 780 - protein, 108 aa, Artificial Sequence; identical to SEQ ID NO: 776
  Description of Artificial Sequence: chemically synthesized sequence

SEQ ID NO: 781 - protein, 6 aa, Artificial Sequence
  Description of Artificial Sequence: chemically synthesized sequence
QSISNW

SEQ ID NO: 782 - protein, 3 aa, Artificial Sequence
  Description of Artificial Sequence: chemically synthesized sequence
KAS

SEQ ID NO: 783 - protein, 9 aa, Artificial Sequence
  Description of Artificial Sequence: chemically synthesized sequence
QQYHSYSYT

SEQ ID NO: 784 - protein, 8 aa, Artificial Sequence
  Description of Artificial Sequence: chemically synthesized sequence
GFTFSRFW

SEQ ID NO: 785 - protein, 8 aa, Artificial Sequence
  Description of Artificial Sequence: chemically synthesized sequence
INQDGTEK

SEQ ID NO: 786 - protein, 14 aa, Artificial Sequence
  Description of Artificial Sequence: chemically synthesized sequence
ANTYYDFWSGHFDY

SEQ ID NO: 787 - protein, 6 aa, Artificial Sequence
  Description of Artificial Sequence: chemically synthesized sequence
QGIRND

SEQ ID NO: 788 - protein, 3 aa, Artificial Sequence
  Description of Artificial Sequence: chemically synthesized sequence
TAS

SEQ ID NO: 789 - protein, 9 aa, Artificial Sequence
  Description of Artificial Sequence: chemically synthesized sequence
LQHNSYPLT

SEQ ID NO: 790 - protein, 8 aa, Artificial Sequence
  Description of Artificial Sequence: chemically synthesized sequence
GFTFSNFG

SEQ ID NO: 791 - protein, 8 aa, Artificial Sequence
  Description of Artificial Sequence: chemically synthesized sequence
LWSDGSNK

SEQ ID NO: 792 - protein, 14 aa, Artificial Sequence
  Description of Artificial Sequence: chemically synthesized sequence
ARGRGAPGIPIFGY

SEQ ID NO: 793 - protein, 3 aa, Artificial Sequence
  Description of Artificial Sequence: chemically synthesized sequence
AAS

SEQ ID NO: 794 - protein, 9 aa, Artificial Sequence
  Description of Artificial Sequence: chemically synthesized sequence
LQHNNYPYT

SEQ ID NO: 795 - protein, 8 aa, Artificial Sequence
  Description of Artificial Sequence: chemically synthesized sequence
GFTFSNAW

SEQ ID NO: 796 - protein, 10 aa, Artificial Sequence
  Description of Artificial Sequence: chemically synthesized sequence
IKRKTDGGTT

SEQ ID NO: 797 - protein, 21 aa, Artificial Sequence
  Description of Artificial Sequence: chemically synthesized sequence
TTDDIVVVPAVMREYYFGMDV

SEQ ID NO: 798 - protein, 11 aa, Artificial Sequence
  Description of Artificial Sequence: chemically synthesized sequence
QTLVHGDGNTY

SEQ ID NO: 799 - protein, 3 aa, Artificial Sequence
  Description of Artificial Sequence: chemically synthesized sequence
KVS

SEQ ID NO: 800 - protein, 9 aa, Artificial Sequence
  Description of Artificial Sequence: chemically synthesized sequence
MQATHFPIT

SEQ ID NO: 801 - protein, 8 aa, Artificial Sequence
  Description of Artificial Sequence: chemically synthesized sequence
GYSFTGYY

SEQ ID NO: 802 - protein, 8 aa, Artificial Sequence
  Description of Artificial Sequence: chemically synthesized sequence
INPNSGTK

SEQ ID NO: 803 - protein, 14 aa, Artificial Sequence
  Description of Artificial Sequence: chemically synthesized sequence
ARDEDWNFGSWFDS

SEQ ID NO: 804 - protein, 11 aa, Artificial Sequence
  Description of Artificial Sequence: chemically synthesized sequence
PSLVHSDGNTY

SEQ ID NO: 805 - protein, 3 aa, Artificial Sequence
  Description of Artificial Sequence: chemically synthesized sequence
KIS

SEQ ID NO: 806 - protein, 8 aa, Artificial Sequence
  Description of Artificial Sequence: chemically synthesized sequence
GYTFTGYY

SEQ ID NO: 807 - protein, 8 aa, Artificial Sequence
  Description of Artificial Sequence: chemically synthesized sequence
LNPNTGTT

SEQ ID NO: 808 - protein, 14 aa, Artificial Sequence
  Description of Artificial Sequence: chemically synthesized sequence
ARDEDWNYGSWFDT

SEQ ID NO: 809 - protein, 6 aa, Artificial Sequence
  Description of Artificial Sequence: chemically synthesized sequence
QSINSY

SEQ ID NO: 810 - protein, 3 aa, Artificial Sequence
  Description of Artificial Sequence: chemically synthesized sequence
VAS

SEQ ID NO: 811 - protein, 10 aa, Artificial Sequence
  Description of Artificial Sequence: chemically synthesized sequence
QQSYSTPPIT

SEQ ID NO: 812 - protein, 8 aa, Artificial Sequence
  Description of Artificial Sequence: chemically synthesized sequence
GFTFDDYG

SEQ ID NO: 813 - protein, 8 aa, Artificial Sequence
  Description of Artificial Sequence: chemically synthesized sequence
IHWHGKRT

SEQ ID NO: 814 - protein, 13 aa, Artificial Sequence
  Description of Artificial Sequence: chemically synthesized sequence
VRGGMSTGDWFDP

SEQ ID NO: 815 - protein, 6 aa, Artificial Sequence
  Description of Artificial Sequence: chemically synthesized sequence
QSISSY

SEQ ID NO: 816 - protein, 8 aa, Artificial Sequence
  Description of Artificial Sequence: chemically synthesized sequence
IHWSGRST

SEQ ID NO: 817 - protein, 13 aa, Artificial Sequence
  Description of Artificial Sequence: chemically synthesized sequence
ARGGMSTGDWFDP

SEQ ID NO: 818 - protein, 6 aa, Artificial Sequence
  Description of Artificial Sequence: chemically synthesized sequence
QTINIY

SEQ ID NO: 819 - protein, 10 aa, Artificial Sequence
  Description of Artificial Sequence: chemically synthesized sequence
HQSYSTPPIT

SEQ ID NO: 820 - protein, 8 aa, Artificial Sequence
  Description of Artificial Sequence: chemically synthesized sequence
GFTVGSNY

SEQ ID NO: 821 - protein, 7 aa, Artificial Sequence
  Description of Artificial Sequence: chemically synthesized sequence
IYSGGST

SEQ ID NO: 822 - protein, 9 aa, Artificial Sequence
  Description of Artificial Sequence: chemically synthesized sequence
ARGIRGLDV

SEQ ID NO: 823 - protein, 7 aa, Artificial Sequence
  Description of Artificial Sequence: chemically synthesized sequence
QSFNFNY

SEQ ID NO: 824 - protein, 3 aa, Artificial Sequence
  Description of Artificial Sequence: chemically synthesized sequence
GAS

SEQ ID NO: 825 - protein, 9 aa, Artificial Sequence
  Description of Artificial Sequence: chemically synthesized sequence
QQYESAPWT

SEQ ID NO: 826 - protein, 8 aa, Artificial Sequence
  Description of Artificial Sequence: chemically synthesized sequence
GGIFSSST

SEQ ID NO: 827 - protein, 8 aa, Artificial Sequence
  Description of Artificial Sequence: chemically synthesized sequence
IIPVFGTV

SEQ ID NO: 828 - protein, 11 aa, Artificial Sequence
  Description of Artificial Sequence: chemically synthesized sequence
ARNWGLGSFYI

SEQ ID NO: 829 - protein, 10 aa, Artificial Sequence
  Description of Artificial Sequence: chemically synthesized sequence
QQSYCTPPIT

SEQ ID NO: 830 - protein, 8 aa, Artificial Sequence
  Description of Artificial Sequence: chemically synthesized sequence
GFPFDEYA

SEQ ID NO: 831 - protein, 8 aa, Artificial Sequence
  Description of Artificial Sequence: chemically synthesized sequence
ISWSNNNI

SEQ ID NO: 832 - protein, 8 aa, Artificial Sequence
  Description of Artificial Sequence: chemically synthesized sequence
AKSGIFDS

SEQ ID NO: 833 - protein, 8 aa, Artificial Sequence
  Description of Artificial Sequence: chemically synthesized sequence
GFTFSSYG

SEQ ID NO: 834 - protein, 8 aa, Artificial Sequence
  Description of Artificial Sequence: chemically synthesized sequence
ISYEGRNK

SEQ ID NO: 835 - protein, 11 aa, Artificial Sequence
  Description of Artificial Sequence: chemically synthesized sequence
AKDRTLYGMDV

SEQ ID NO: 836 - protein, 6 aa, Artificial Sequence
  Description of Artificial Sequence: chemically synthesized sequence
QVISNY

SEQ ID NO: 837 - protein, 9 aa, Artificial Sequence
  Description of Artificial Sequence: chemically synthesized sequence
QKYNSAPRT

SEQ ID NO: 838 - protein, 10 aa, Artificial Sequence
  Description of Artificial Sequence: chemically synthesized sequence
GFSLSTNRMC

SEQ ID NO: 839 - protein, 7 aa, Artificial Sequence
  Description of Artificial Sequence: chemically synthesized sequence
IDWDGVK

SEQ ID NO: 840 - protein, 13 aa, Artificial Sequence
  Description of Artificial Sequence: chemically synthesized sequence
ARSTSLTFYYFDY

SEQ ID NO: 841 - protein, 6 aa, Artificial Sequence
  Description of Artificial Sequence: chemically synthesized sequence
QNINNY

SEQ ID NO: 842 - protein, 9 aa, Artificial Sequence
  Description of Artificial Sequence: chemically synthesized sequence
QQSYNTPLT

SEQ ID NO: 843 - protein, 8 aa, Artificial Sequence
  Description of Artificial Sequence: chemically synthesized sequence
EFTVGTNH

SEQ ID NO: 844 - protein, 7 aa, Artificial Sequence
  Description of Artificial Sequence: chemically synthesized sequence
IYSGGNT

SEQ ID NO: 845 - protein, 9 aa, Artificial Sequence
  Description of Artificial Sequence: chemically synthesized sequence
ARGLGGMDV

SEQ ID NO: 846 - protein, 6 aa, Artificial Sequence
  Description of Artificial Sequence: chemically synthesized sequence
QTISTY

SEQ ID NO: 847 - protein, 9 aa, Artificial Sequence
  Description of Artificial Sequence: chemically synthesized sequence
LQHNSYPYT

SEQ ID NO: 848 - protein, 8 aa, Artificial Sequence
  Description of Artificial Sequence: chemically synthesized sequence
GFTFSKYW

SEQ ID NO: 849 - protein, 8 aa, Artificial Sequence
  Description of Artificial Sequence: chemically synthesized sequence
IKGDGSEK

SEQ ID NO: 850 - protein, 13 aa, Artificial Sequence
  Description of Artificial Sequence: chemically synthesized sequence
ARDYWGSGYYFDF

SEQ ID NO: 851 - protein, 3 aa, Artificial Sequence
  Description of Artificial Sequence: chemically synthesized sequence
VVS

SEQ ID NO: 852 - protein, 9 aa, Artificial Sequence
  Description of Artificial Sequence: chemically synthesized sequence
QQSYSTPFT

SEQ ID NO: 853 - protein, 8 aa, Artificial Sequence
  Description of Artificial Sequence: chemically synthesized sequence
GFTFSSYW

SEQ ID NO: 854 - protein, 8 aa, Artificial Sequence
  Description of Artificial Sequence: chemically synthesized sequence
IKQDGSEK

SEQ ID NO: 855 - protein, 23 aa, Artificial Sequence
  Description of Artificial Sequence: chemically synthesized sequence
ARDDIVVVPAPMGYYYYYFGMDV

SEQ ID NO: 856 - protein, 8 aa, Artificial Sequence
  Description of Artificial Sequence: chemically synthesized sequence
GFTFDDFA

SEQ ID NO: 857 - protein, 8 aa, Artificial Sequence
  Description of Artificial Sequence: chemically synthesized sequence
ISWTGGNM

SEQ ID NO: 858 - protein, 16 aa, Artificial Sequence
  Description of Artificial Sequence: chemically synthesized sequence
VKDIRGIVATGGAFDI

SEQ ID NO: 859 - protein, 8 aa, Artificial Sequence
  Description of Artificial Sequence: chemically synthesized sequence
GFTVGTNY

SEQ ID NO: 860 - protein, 9 aa, Artificial Sequence
  Description of Artificial Sequence: chemically synthesized sequence
ARGIRGFDI

SEQ ID NO: 861 - protein, 8 aa, Artificial Sequence
  Description of Artificial Sequence: chemically synthesized sequence
GFTISTNY

SEQ ID NO: 862 - protein, 7 aa, Artificial Sequence
  Description of Artificial Sequence: chemically synthesized sequence
IYSSGST

SEQ ID NO: 863 - protein, 8 aa, Artificial Sequence
  Description of Artificial Sequence: chemically synthesized sequence
GFTIDDSA

SEQ ID NO: 864 - protein, 8 aa, Artificial Sequence
  Description of Artificial Sequence: chemically synthesized sequence
ISWKSGSI

SEQ ID NO: 865 - protein, 17 aa, Artificial Sequence
  Description of Artificial Sequence: chemically synthesized sequence
VKDIRGNWNYGGNWFDP

SEQ ID NO: 866 - protein, 8 aa, Artificial Sequence
  Description of Artificial Sequence: chemically synthesized sequence
GFTVGVNH

SEQ ID NO: 867 - protein, 7 aa, Artificial Sequence
  Description of Artificial Sequence: chemically synthesized sequence
IFSSGRT

SEQ ID NO: 868 - protein, 9 aa, Artificial Sequence
  Description of Artificial Sequence: chemically synthesized sequence
ARGIGGLDI

SEQ ID NO: 869 - protein, 8 aa, Artificial Sequence
  Description of Artificial Sequence: chemically synthesized sequence
GFTFDDYA

SEQ ID NO: 870 - protein, 8 aa, Artificial Sequence
  Description of Artificial Sequence: chemically synthesized sequence
ISWTGGTI

SEQ ID NO: 871 - protein, 16 aa, Artificial Sequence
  Description of Artificial Sequence: chemically synthesized sequence
TRDIRGNWKYGGWFDP

SEQ ID NO: 872 - protein, 8 aa, Artificial Sequence
  Description of Artificial Sequence: chemically synthesized sequence
GYTFTAYY

SEQ ID NO: 873 - protein, 8 aa, Artificial Sequence
  Description of Artificial Sequence: chemically synthesized sequence
ISPNSGFT

SEQ ID NO: 874 - protein, 13 aa, Artificial Sequence
  Description of Artificial Sequence: chemically synthesized sequence
AREGSTHHNSFDP

SEQ ID NO: 875 - protein, 8 aa, Artificial Sequence
  Description of Artificial Sequence: chemically synthesized sequence
GFTVGTNF

SEQ ID NO: 876 - protein, 8 aa, Artificial Sequence
  Description of Artificial Sequence: chemically synthesized sequence
IIPILGAA

SEQ ID NO: 877 - protein, 8 aa, Artificial Sequence
  Description of Artificial Sequence: chemically synthesized sequence
ARGGGMDV

SEQ ID NO: 878 - protein, 8 aa, Artificial Sequence
  Description of Artificial Sequence: chemically synthesized sequence
GGTFNTYV

SEQ ID NO: 879 - protein, 8 aa, Artificial Sequence
  Description of Artificial Sequence: chemically synthesized sequence
ISPYNGYT

SEQ ID NO: 880 - protein, 11 aa, Artificial Sequence
  Description of Artificial Sequence: chemically synthesized sequence
ARDRTSGGFDP

SEQ ID NO: 881 - protein, 8 aa, Artificial Sequence
  Description of Artificial Sequence: chemically synthesized sequence
GYIFTHYG

SEQ ID NO: 882 - protein, 12 aa, Artificial Sequence
  Description of Artificial Sequence: chemically synthesized sequence
SRGRGPYWSFDL

SEQ ID NO: 883 - protein, 8 aa, Artificial Sequence
  Description of Artificial Sequence: chemically synthesized sequence
LSGRSGNH

SEQ ID NO: 884 - protein, 9 aa, Artificial Sequence
  Description of Artificial Sequence: chemically synthesized sequence
SGRSANPRG

SEQ ID NO: 885 - protein, 8 aa, Artificial Sequence
  Description of Artificial Sequence: chemically synthesized sequence
LSGRSDDH

SEQ ID NO: 886 - protein, 8 aa, Artificial Sequence
  Description of Artificial Sequence: chemically synthesized sequence
LSGRSDIH

SEQ ID NO: 887 - protein, 8 aa, Artificial Sequence
  Description of Artificial Sequence: chemically synthesized sequence
LSGRSDQH

SEQ ID NO: 888 - protein, 8 aa, Artificial Sequence
  Description of Artificial Sequence: chemically synthesized sequence
LSGRSDTH

SEQ ID NO: 889 - protein, 8 aa, Artificial Sequence
  Description of Artificial Sequence: chemically synthesized sequence
LSGRSDYH

SEQ ID NO: 890 - protein, 8 aa, Artificial Sequence
  Description of Artificial Sequence: chemically synthesized sequence
LSGRSDNP

SEQ ID NO: 891 - protein, 8 aa, Artificial Sequence
  Description of Artificial Sequence: chemically synthesized sequence
LSGRSANP

SEQ ID NO: 892 - protein, 8 aa, Artificial Sequence
  Description of Artificial Sequence: chemically synthesized sequence
LSGRSANI

SEQ ID NO: 893 - protein, 8 aa, Artificial Sequence
  Description of Artificial Sequence: chemically synthesized sequence
LSGRSDNI

SEQ ID NO: 894 - protein, 8 aa, Artificial Sequence
  Description of Artificial Sequence: chemically synthesized sequence
MIAPVAYR

SEQ ID NO: 895 - protein, 8 aa, Artificial Sequence
  Description of Artificial Sequence: chemically synthesized sequence
RPSPMWAY

SEQ ID NO: 896 - protein, 8 aa, Artificial Sequence
  Description of Artificial Sequence: chemically synthesized sequence
WATPRPMR

SEQ ID NO: 897 - protein, 8 aa, Artificial Sequence
  Description of Artificial Sequence: chemically synthesized sequence
FRLLDWQW

SEQ ID NO: 898 - protein, 5 aa, Artificial Sequence
  Description of Artificial Sequence: chemically synthesized sequence
ISSGL

SEQ ID NO: 899 - protein, 7 aa, Artificial Sequence
  Description of Artificial Sequence: chemically synthesized sequence
ISSGLLS

SEQ ID NO: 900 - protein, 6 aa, Artificial Sequence
  Description of Artificial Sequence: chemically synthesized sequence
ISSGLL

SEQ ID NO: 901 - protein, 15 aa, Artificial Sequence
  Description of Artificial Sequence: chemically synthesized sequence
ISSGLLSGRSANPRG

SEQ ID NO: 902 - protein, 18 aa, Artificial Sequence
  Description of Artificial Sequence: chemically synthesized sequence
AVGLLAPPTSGRSANPRG

SEQ ID NO: 903 - protein, 17 aa, Artificial Sequence
  Description of Artificial Sequence: chemically synthesized sequence
AVGLLAPPSGRSANPRG

SEQ ID NO: 904 - protein, 13 aa, Artificial Sequence
  Description of Artificial Sequence: chemically synthesized sequence
ISSGLLSGRSDDH

SEQ ID NO: 905 - protein, 13 aa, Artificial Sequence
  Description of Artificial Sequence: chemically synthesized sequence
ISSGLLSGRSDIH

SEQ ID NO: 906 - protein, 13 aa, Artificial Sequence
  Description of Artificial Sequence: chemically synthesized sequence
ISSGLLSGRSDQH

SEQ ID NO: 907 - protein, 13 aa, Artificial Sequence
  Description of Artificial Sequence: chemically synthesized sequence
ISSGLLSGRSDTH

SEQ ID NO: 908 - protein, 13 aa, Artificial Sequence
  Description of Artificial Sequence: chemically synthesized sequence
ISSGLLSGRSDYH

SEQ ID NO: 909 - protein, 13 aa, Artificial Sequence
  Description of Artificial Sequence: chemically synthesized sequence
ISSGLLSGRSDNP

SEQ ID NO: 910 - protein, 13 aa, Artificial Sequence
  Description of Artificial Sequence: chemically synthesized sequence
ISSGLLSGRSANP

SEQ ID NO: 911 - protein, 13 aa, Artificial Sequence
  Description of Artificial Sequence: chemically synthesized sequence
ISSGLLSGRSANI

SEQ ID NO: 912 - protein, 18 aa, Artificial Sequence
  Description of Artificial Sequence: chemically synthesized sequence
AVGLLAPPGGLSGRSDDH

SEQ ID NO: 913 - protein, 18 aa, Artificial Sequence
  Description of Artificial Sequence: chemically synthesized sequence
AVGLLAPPGGLSGRSDIH

SEQ ID NO: 914 - protein, 18 aa, Artificial Sequence
  Description of Artificial Sequence: chemically synthesized sequence
AVGLLAPPGGLSGRSDQH

SEQ ID NO: 915 - protein, 18 aa, Artificial Sequence
  Description of Artificial Sequence: chemically synthesized sequence
AVGLLAPPGGLSGRSDTH

SEQ ID NO: 916 - protein, 18 aa, Artificial Sequence
  Description of Artificial Sequence: chemically synthesized sequence
AVGLLAPPGGLSGRSDYH

SEQ ID NO: 917 - protein, 18 aa, Artificial Sequence
  Description of Artificial Sequence: chemically synthesized sequence
AVGLLAPPGGLSGRSDNP

SEQ ID NO: 918 - protein, 18 aa, Artificial Sequence
  Description of Artificial Sequence: chemically synthesized sequence
AVGLLAPPGGLSGRSANP

SEQ ID NO: 919 - protein, 18 aa, Artificial Sequence
  Description of Artificial Sequence: chemically synthesized sequence
AVGLLAPPGGLSGRSANI

SEQ ID NO: 920 - protein, 13 aa, Artificial Sequence
  Description of Artificial Sequence: chemically synthesized sequence
ISSGLLSGRSDNI

SEQ ID NO: 921 - protein, 18 aa, Artificial Sequence
  Description of Artificial Sequence: chemically synthesized sequence
AVGLLAPPGGLSGRSDNI

SEQ ID NO: 922 - protein, 6 aa, Artificial Sequence
  Description of Artificial Sequence: chemically synthesized sequence
GGSGGS

SEQ ID NO: 923 - protein, 6 aa, Artificial Sequence
  Description of Artificial Sequence: chemically synthesized sequence
QGQSGS

SEQ ID NO: 924 - protein, 7 aa, Artificial Sequence
  Description of Artificial Sequence: chemically synthesized sequence
QGQSGQG

SEQ ID NO: 925 - protein, 5 aa, Artificial Sequence
  Description of Artificial Sequence: chemically synthesized sequence
QSGQG

SEQ ID NO: 926 - protein, 4 aa, Artificial Sequence
  Description of Artificial Sequence: chemically synthesized sequence
SGQG

SEQ ID NO: 927 - protein, 3 aa, Artificial Sequence
  Description of Artificial Sequence: chemically synthesized sequence
GQG

SEQ ID NO: 928 - protein, 2 aa, Artificial Sequence
  Description of Artificial Sequence: chemically synthesized sequence
QG

SEQ ID NO: 929 - DNA, 18 bp, Artificial Sequence
  Description of Artificial Sequence: chemically synthesized sequence
caaggtcagtctggatcc

SEQ ID NO: 930 - DNA, 516 bp, Artificial Sequence
  Description of Artificial Sequence: chemically synthesized sequence
tattgcgaggttagtgagctgtttgttcttccttggtgcatgggtggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 931 - protein, 151 aa, Artificial Sequence
  Description of Artificial Sequence: chemically synthesized sequence
YCEVSELFVLPWCMGGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 932 - DNA, 516 bp, Artificial Sequence
  Description of Artificial Sequence: chemically synthesized sequence
tcttgccttatgcatccgcattatgctcatgattattgctatgttggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 933 - protein, 151 aa, Artificial Sequence
  Description of Artificial Sequence: chemically synthesized sequence
SCLMHPHYAHDYCYVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 934 - DNA, 516 bp, Artificial Sequence
  Description of Artificial Sequence: chemically synthesized sequence
ttgtgcgaggttttgatgttgttgcagcatccgtggtgcatggggggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 935 - protein, 151 aa, Artificial Sequence
  Description of Artificial Sequence: chemically synthesized sequence
LCEVLMLLQHPWCMGGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 936 - DNA, 516 bp, Artificial Sequence
  Description of Artificial Sequence: chemically synthesized sequence
attgcgtgccggcattttatggagcagttgccgttttgccatcatggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 937 - protein, 151 aa, Artificial Sequence
  Description of Artificial Sequence: chemically synthesized sequence
IACRHFMEQLPFCHHGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 938 - DNA, 516 bp, Artificial Sequence
  Description of Artificial Sequence: chemically synthesized sequence
tttggtcctaggtgcggtgaggcttctacttgcgttccgtatgagggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 939 - protein, 151 aa, Artificial Sequence
  Description of Artificial Sequence: chemically synthesized sequence
FGPRCGEASTCVPYEGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 940 - DNA, 516 bp, Artificial Sequence
  Description of Artificial Sequence: chemically synthesized sequence
attctttattgcgatagttggggggcggggtgcttgacgcggccgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 941 - protein, 151 aa, Artificial Sequence
  Description of Artificial Sequence: chemically synthesized sequence
ILYCDSWGAGCLTRPGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 942 - DNA, 516 bp, Artificial Sequence
  Description of Artificial Sequence: chemically synthesized sequence
gggattgcgttgtgcccgtctcatttttgccagctgcctcagactggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 943 - protein, 151 aa, Artificial Sequence
  Description of Artificial Sequence: chemically synthesized sequence
GIALCPSHFCQLPQTGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 944 - DNA, 516 bp, Artificial Sequence
  Description of Artificial Sequence: chemically synthesized sequence
gatgggccgcgttgctttgtgtcgggggagtgctctccgattggtggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 945 - protein, 151 aa, Artificial Sequence
  Description of Artificial Sequence: chemically synthesized sequence
DGPRCFVSGECSPIGGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 946 - DNA, 516 bp, Artificial Sequence
  Description of Artificial Sequence: chemically synthesized sequence
ttgtgctataagctggattatgatgataggtcttattgccatattggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 947 - protein, 151 aa, Artificial Sequence
  Description of Artificial Sequence: chemically synthesized sequence
LCYKLDYDDRSYCHIGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 948 - DNA, 516 bp, Artificial Sequence
  Description of Artificial Sequence: chemically synthesized sequence
ccgtgccatccgcatccttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 949 - protein, 151 aa, Artificial Sequence
  Description of Artificial Sequence: chemically synthesized sequence
PCHPHPYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 950 - DNA, 516 bp, Artificial Sequence
  Description of Artificial Sequence: chemically synthesized sequence
ccttgctattggcatcctttttttgcgtataggtattgcaatactggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 951 - protein, 151 aa, Artificial Sequence
  Description of Artificial Sequence: chemically synthesized sequence
PCYWHPFFAYRYCNTGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 952 - DNA, 516 bp, Artificial Sequence
  Description of Artificial Sequence: chemically synthesized sequence
gtttgctattatatggattggttggggcggaattggtgctcttcgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 953 - protein, 151 aa, Artificial Sequence
  Description of Artificial Sequence: chemically synthesized sequence
VCYYMDWLGRNWCSSGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 954 - DNA, 516 bp, Artificial Sequence
  Description of Artificial Sequence: chemically synthesized sequence
ctgtgcgatctgtttaagttgcgtgagtttccttattgcatggggggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 955 - protein, 151 aa, Artificial Sequence
  Description of Artificial Sequence: chemically synthesized sequence
LCDLFKLREFPYCMGGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 956 - DNA, 516 bp, Artificial Sequence
  Description of Artificial Sequence: chemically synthesized sequence
tatcttccgtgccattttgttccgattggggcttgcaataataagggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 957 - protein, 151 aa, Artificial Sequence
  Description of Artificial Sequence: chemically synthesized sequence
YLPCHFVPIGACNNKGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 958 - DNA, 516 bp, Artificial Sequence
  Description of Artificial Sequence: chemically synthesized sequence
attttttgccatatgggtgttgtggttcctcagtgcgcgaattatggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 959 - protein, 151 aa, Artificial Sequence
  Description of Artificial Sequence: chemically synthesized sequence
IFCHMGVVVPQCANYGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 960 - DNA, 516 bp, Artificial Sequence
  Description of Artificial Sequence: chemically synthesized sequence
gcgtgccatccgcatccttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 961 - protein, 151 aa, Artificial Sequence
  Description of Artificial Sequence: chemically synthesized sequence
ACHPHPYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 962 - DNA, 516 bp, Artificial Sequence
  Description of Artificial Sequence: chemically synthesized sequence
ccgtgccatccggctccttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 963 - protein, 151 aa, Artificial Sequence
  Description of Artificial Sequence: chemically synthesized sequence
PCHPAPYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 964 - DNA, 516 bp, Artificial Sequence
  Description of Artificial Sequence: chemically synthesized sequence
ccgtgccatccgcatgcttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 965 - protein, 151 aa, Artificial Sequence
  Description of Artificial Sequence: chemically synthesized sequence
PCHPHAYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 966 - DNA, 516 bp, Artificial Sequence
  Description of Artificial Sequence: chemically synthesized sequence
ccgtgccatccgcatcctgctgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 967 - protein, 151 aa, Artificial Sequence
  Description of Artificial Sequence: chemically synthesized sequence
PCHPHPADARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 968 - DNA, 516 bp, Artificial Sequence
  Description of Artificial Sequence: chemically synthesized sequence
ccgtgccatccgcatccttatgctgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 969 - protein, 151 aa, Artificial Sequence
  Description of Artificial Sequence: chemically synthesized sequence
PCHPHPYAARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 970 - DNA, 516 bp, Artificial Sequence
  Description of Artificial Sequence: chemically synthesized sequence
ccgtgccatccgcatccttatgatgctgctccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 971 - protein, 151 aa, Artificial Sequence
  Description of Artificial Sequence: chemically synthesized sequence
PCHPHPYDAAPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 972 - DNA, 516 bp, Artificial Sequence
  Description of Artificial Sequence: chemically synthesized sequence
ccgtgccatccgcatccttatgatgctcgtcctgcttgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 973 - protein, 151 aa, Artificial Sequence
  Description of Artificial Sequence: chemically synthesized sequence
PCHPHPYDARPACNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 974 - DNA, 516 bp, Artificial Sequence
  Description of Artificial Sequence: chemically synthesized sequence
ccgtgccatccgcatccttatgatgctcgtccttattgcgctgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 975 - protein, 151 aa, Artificial Sequence
  Description of Artificial Sequence: chemically synthesized sequence
PCHPHPYDARPYCAVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 976 - DNA, 516 bp, Artificial Sequence
  Description of Artificial Sequence: chemically synthesized sequence
ccgtgccatgcgcatccttatgatgctcgtccttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 977 - protein, 151 aa, Artificial Sequence
  Description of Artificial Sequence: chemically synthesized sequence
PCHAHPYDARPYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 978 - DNA, 516 bp, Artificial Sequence
  Description of Artificial Sequence: chemically synthesized sequence
ccgtgccatccgcatccttatgatgctcgtgcttattgcaatgtgggaggtggctcgagcggtggcagcggtggctctggtggtactagcacctctggtcgttccgctaacccacgtggcggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 979 - protein, 151 aa, Artificial Sequence
  Description of Artificial Sequence: chemically synthesized sequence
PCHPHPYDARAYCNVGGGSSGGSGGSGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 980 - DNA, 474 bp, Artificial Sequence
  Description of Artificial Sequence: chemically synthesized sequence
ggaggtggctcgagcggtggcagcggtggctctggtggtattagcagtggtctgttaagcggtcgtagcgataatcatggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 981 - protein, 152 aa, Artificial Sequence
  Description of Artificial Sequence: chemically synthesized sequence
LCEVLMLLQHPWCMGGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 982 - DNA, 474 bp, Artificial Sequence; identical to SEQ ID NO: 980
  Description of Artificial Sequence: chemically synthesized sequence

SEQ ID NO: 983 - protein, 152 aa, Artificial Sequence
  Description of Artificial Sequence: chemically synthesized sequence
ILYCDSWGAGCLTRPGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 984 - DNA, 474 bp, Artificial Sequence; identical to SEQ ID NO: 980
  Description of Artificial Sequence: chemically synthesized sequence

SEQ ID NO: 985 - protein, 152 aa, Artificial Sequence
  Description of Artificial Sequence: chemically synthesized sequence
GIALCPSHFCQLPQTGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 986 - DNA, 474 bp, Artificial Sequence; identical to SEQ ID NO: 980
  Description of Artificial Sequence: chemically synthesized sequence

SEQ ID NO: 987 - protein, 152 aa, Artificial Sequence
  Description of Artificial Sequence: chemically synthesized sequence
PCHPHPYDARPYCNVGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 988 - DNA, 474 bp, Artificial Sequence; identical to SEQ ID NO: 980
  Description of Artificial Sequence: chemically synthesized sequence

SEQ ID NO: 989 - protein, 152 aa, Artificial Sequence
  Description of Artificial Sequence: chemically synthesized sequence
YLPCHFVPIGACNNKGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 990 - DNA, 474 bp, Artificial Sequence; identical to SEQ ID NO: 980
  Description of Artificial Sequence: chemically synthesized sequence

SEQ ID NO: 991 - protein, 152 aa, Artificial Sequence
  Description of Artificial Sequence: chemically synthesized sequence
IFCHMGVVVPQCANYGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 992 - DNA, 474 bp, Artificial Sequence; identical to SEQ ID NO: 980
  Description of Artificial Sequence: chemically synthesized sequence

SEQ ID NO: 993 - protein, 152 aa, Artificial Sequence
  Description of Artificial Sequence: chemically synthesized sequence
PCHPHAYDARPYCNVGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 994 - DNA, 477 bp, Artificial Sequence
  Description of Artificial Sequence: chemically synthesized sequence
ggaggtggctcgagcggtggcagcggtgctgtgggtctcctggctcccccgggcggcctgtccggccgcagcgataatcatggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgtgaggccactcacaagacatcaacttcacccattgtcaagagcttcaacaggaatgagtgt

SEQ ID NO: 995 - protein, 153 aa, Artificial Sequence
  Description of Artificial Sequence: chemically synthesized sequence
LCEVLMLLQHPWCMGGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 996 - DNA, 477 bp, Artificial Sequence
  Description of Artificial Sequence: chemically synthesized sequence
ggaggtggctcgagcggtggcagcggtgctgtgggtctcctggctcccccgggcggcctgtccggccgcagcgataatcatggcggttctgacatccagatgacccagagccccagcagcctgtctgctagcgtgggcgacagagtgaccatcacctgtagagccagccagagcatcagcagctacctgaactggtatcagcagaagcccggcaaggcccccaaactgctgatctacgccgccagctctctgcagtctggcgtgcccagcagattttccggcagcggctctggcaccgacttcaccctgaccatcagctccctgcagcccgaggacttcgccacctactactgccagcaggacaacggctaccccagcacctttggcggaggtaccaaggtggaaatcaagcgttgcgaagtcacccatcagggcctgagctcgcccgtcacaaagagcttcaacaggggagagtgt

SEQ ID NO: 997 - protein, 153 aa, Artificial Sequence
  Description of Artificial Sequence: chemically synthesized sequence
ILYCDSWGAGCLTRPGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 998 - DNA, 477 bp, Artificial Sequence; identical to SEQ ID NO: 996
  Description of Artificial Sequence: chemically synthesized sequence

SEQ ID NO: 999 - protein, 153 aa, Artificial Sequence
  Description of Artificial Sequence: chemically synthesized sequence
GIALCPSHFCQLPQTGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1000 - DNA, 477 bp, Artificial Sequence; identical to SEQ ID NO: 996
  Description of Artificial Sequence: chemically synthesized sequence

SEQ ID NO: 1001 - protein, 153 aa, Artificial Sequence
  Description of Artificial Sequence: chemically synthesized sequence
YLPCHFVPIGACNNKGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1002 - DNA, 477 bp, Artificial Sequence; identical to SEQ ID NO: 994
  Description of Artificial Sequence: chemically synthesized sequence

SEQ ID NO: 1003 - protein, 153 aa, Artificial Sequence
  Description of Artificial Sequence: chemically synthesized sequence
IFCHMGVVVPQCANYGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1004 - DNA, 477 bp, Artificial Sequence; identical to SEQ ID NO: 994
  Description of Artificial Sequence: chemically synthesized sequence

SEQ ID NO: 1005 - protein, 153 aa, Artificial Sequence
  Description of Artificial Sequence: chemically synthesized sequence
PCHPHAYDARPYCNVGGGSSGGSGAVGLLAPPGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1006 - DNA, 18 bp, Artificial Sequence
  Description of Artificial Sequence: chemically synthesized sequence
cagggccagtccggctca

SEQ ID NO: 1007 - DNA, 786 bp, Artificial Sequence
  Description of Artificial Sequence: chemically synthesized sequence
tatctgccctgccacttcgtgccaatcggggcctgtaacaataagggcggtggatctagtggtggctcaggcgggtctggcggcatttccagtggactcttgtcaggacgatccgataatcatggcgggtccgacatccagatgacacagagcccttcttccctctccgcaagcgttggcgacagggtcaccattacctgtagggcttctcagagcatctcaagctatctgaactggtaccagcagaaacctggaaaggctccaaaactgctgatttacgctgcctccagtcttcagtcaggcgtcccctccagatttagcggatcaggtagtggaactgattttacccttacaatatcttctctgcagccagaggacttcgccacatactattgtcagcaagacaatggttaccccagtacatttggcggagggacaaaggtcgagatcaaaaggaccgtagcagcaccaagcgtctttattttcccccccagtgacgaacagctgaagagcggaacagcttcagtggtgtgtctcctgaataacttctatccacgcgaggcaaaggtgcagtggaaggtggacaatgcactgcagtctggtaattcccaagaaagtgttactgagcaggattccaaggattcaacttactctctgtctagcaccctgactctttctaaagcagattatgagaagcataaggtctacgcttgcgaggtgacccaccaggggctttcctctccagttaccaagtcattcaaccggggtgagtgttgatgagaattc

SEQ ID NO: 1008 - protein, 258 aa, Artificial Sequence
  Description of Artificial Sequence: chemically synthesized sequence
GIALCPSHFCQLPQTGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1009 - protein, 19 aa, Artificial Sequence
  Description of Artificial Sequence: chemically synthesized sequence
GLSGRSDNHGGAVGLLAPP

SEQ ID NO: 1010 - protein, 21 aa, Artificial Sequence
  Description of Artificial Sequence: chemically synthesized sequence
GLSGRSDNHGGVHMPLGFLGP

SEQ ID NO: 1011 - protein, 6 aa, Artificial Sequence
  Description of Artificial Sequence: chemically synthesized sequence
QSMSSY

SEQ ID NO: 1012 - protein, 8 aa, Artificial Sequence
  Description of Artificial Sequence: chemically synthesized sequence
GITVGTNY

SEQ ID NO: 1013 - protein, 7 aa, Artificial Sequence
  Description of Artificial Sequence: chemically synthesized sequence
ISSGGNT

SEQ ID NO: 1014 - protein, 13 aa, Artificial Sequence
  Description of Artificial Sequence: chemically synthesized sequence
QASESVYSNNYLS

SEQ ID NO: 1015 - protein, 7 aa, Artificial Sequence
  Description of Artificial Sequence: chemically synthesized sequence
LASTLAS

SEQ ID NO: 1016 - protein, 12 aa, Artificial Sequence
  Description of Artificial Sequence: chemically synthesized sequence
IGGKSSSTDGNA

SEQ ID NO: 1017 - protein, 5 aa, Artificial Sequence
  Description of Artificial Sequence: chemically synthesized sequence
SNGLT

SEQ ID NO: 1018 - protein, 16 aa, Artificial Sequence
  Description of Artificial Sequence: chemically synthesized sequence
TINKDASAYYASWAKG

SEQ ID NO: 1019 - protein, 9 aa, Artificial Sequence
  Description of Artificial Sequence: chemically synthesized sequence
IAFKTGTSI

SEQ ID NO: 1020 - protein, 16 aa, Artificial Sequence
  Description of Artificial Sequence: chemically synthesized sequence
RSSKSLLHSNGITYLY

SEQ ID NO: 1021 - protein, 7 aa, Artificial Sequence
  Description of Artificial Sequence: chemically synthesized sequence
QMSNLAS

SEQ ID NO: 1022 - protein, 9 aa, Artificial Sequence
  Description of Artificial Sequence: chemically synthesized sequence
AQNLEPPLT

SEQ ID NO: 1023 - protein, 5 aa, Artificial Sequence
  Description of Artificial Sequence: chemically synthesized sequence
DYYTH

SEQ ID NO: 1024 - protein, 17 aa, Artificial Sequence
  Description of Artificial Sequence: chemically synthesized sequence
WIDPENGKTAYAPKFQG

SEQ ID NO: 1025 - protein, 10 aa, Artificial Sequence
  Description of Artificial Sequence: chemically synthesized sequence
GGYDVYFLDY

SEQ ID NO: 1026 - protein, 11 aa, Artificial Sequence
  Description of Artificial Sequence: chemically synthesized sequence
KASQDVGIVVA

SEQ ID NO: 1027 - protein, 7 aa, Artificial Sequence
  Description of Artificial Sequence: chemically synthesized sequence
WASIRHT

SEQ ID NO: 1028 - protein, 10 aa, Artificial Sequence
  Description of Artificial Sequence: chemically synthesized sequence
QQYSNYPLYT

SEQ ID NO: 1029 - protein, 10 aa, Artificial Sequence
  Description of Artificial Sequence: chemically synthesized sequence
GFSLTSYGVH

SEQ ID NO: 1030 - protein, 16 aa, Artificial Sequence
  Description of Artificial Sequence: chemically synthesized sequence
VIWAGGSTNYNSALMS

SEQ ID NO: 1031 - protein, 11 aa, Artificial Sequence
  Description of Artificial Sequence: chemically synthesized sequence
AKPYGNSAMDY

SEQ ID NO: 1032 - protein, 16 aa, Artificial Sequence
  Description of Artificial Sequence: chemically synthesized sequence
VIWAGGSTNYVDSVKG

SEQ ID NO: 1033 - protein, 11 aa, Artificial Sequence
  Description of Artificial Sequence: chemically synthesized sequence
AKPYGTSAMDY

SEQ ID NO: 1034 - protein, 16 aa, Artificial Sequence
  Description of Artificial Sequence: chemically synthesized sequence
VIWAGGSTNYADSVKG

SEQ ID NO: 1035 - protein, 14 aa, Artificial Sequence
  Description of Artificial Sequence: chemically synthesized sequence
ASQSVSTSSSSFMH

SEQ ID NO: 1036 - protein, 7 aa, Artificial Sequence
  Description of Artificial Sequence: chemically synthesized sequence
YASNLES

SEQ ID NO: 1037 - protein, 9 aa, Artificial Sequence
  Description of Artificial Sequence: chemically synthesized sequence
QHSWEIPYT

SEQ ID NO: 1038 - protein, 5 aa, Artificial Sequence
  Description of Artificial Sequence: chemically synthesized sequence
SYGMS

SEQ ID NO: 1039 - protein, 16 aa, Artificial Sequence
  Description of Artificial Sequence: chemically synthesized sequence
SISSGGSTYYPDSVKG

SEQ ID NO: 1040 - protein, 8 aa, Artificial Sequence
  Description of Artificial Sequence: chemically synthesized sequence
GYDSGFAY

SEQ ID NO: 1041 - protein, 15 aa, Artificial Sequence
  Description of Artificial Sequence: chemically synthesized sequence
RASQSVSTSSSSYMH

SEQ ID NO: 1042 - protein, 16 aa, Artificial Sequence
  Description of Artificial Sequence: chemically synthesized sequence
SISSGGTTYYPDSVKG

SEQ ID NO: 1043 - protein, 11 aa, Artificial Sequence
  Description of Artificial Sequence: chemically synthesized sequence
KASQSVSNDVA

SEQ ID NO: 1044 - protein, 7 aa, Artificial Sequence
  Description of Artificial Sequence: chemically synthesized sequence
YAANRYT

SEQ ID NO: 1045 - protein, 9 aa, Artificial Sequence
  Description of Artificial Sequence: chemically synthesized sequence
QQDYTSPYT

SEQ ID NO: 1046 - protein, 5 aa, Artificial Sequence
  Description of Artificial Sequence: chemically synthesized sequence
TYGVH

SEQ ID NO: 1047 - protein, 17 aa, Artificial Sequence
  Description of Artificial Sequence: chemically synthesized sequence
VIWRGVTTDYNAAFMAS

SEQ ID NO: 1048 - protein, 8 aa, Artificial Sequence
  Description of Artificial Sequence: chemically synthesized sequence
LGFYAMDY

SEQ ID NO: 1049 - protein, 11 aa, Artificial Sequence
  Description of Artificial Sequence: chemically synthesized sequence
KASQSVSNDVG

SEQ ID NO: 1050 - protein, 7 aa, Artificial Sequence
  Description of Artificial Sequence: chemically synthesized sequence
YASNRYS

SEQ ID NO: 1051 - protein, 5 aa, Artificial Sequence
  Description of Artificial Sequence: chemically synthesized sequence
SYGVH

SEQ ID NO: 1052 - protein, 16 aa, Artificial Sequence
  Description of Artificial Sequence: chemically synthesized sequence
VIWSGGVTDYNAAFIS

SEQ ID NO: 1053 - protein, 16 aa, Artificial Sequence
  Description of Artificial Sequence: chemically synthesized sequence
RSSQIIVHSNANTYLE

SEQ ID NO: 1054 - protein, 7 aa, Artificial Sequence
  Description of Artificial Sequence: chemically synthesized sequence
KVSNRFS

SEQ ID NO: 1055 - protein, 9 aa, Artificial Sequence
  Description of Artificial Sequence: chemically synthesized sequence
FQGSHVPYT

SEQ ID NO: 1056 - protein, 5 aa, Artificial Sequence
  Description of Artificial Sequence: chemically synthesized sequence
TYWMH

SEQ ID NO: 1057 - protein, 17 aa, Artificial Sequence
  Description of Artificial Sequence: chemically synthesized sequence
QINPDSTTINTAPSLKD

SEQ ID NO: 1058 - protein, 10 aa, Artificial Sequence
  Description of Artificial Sequence: chemically synthesized sequence
PGDYGYDFDC

SEQ ID NO: 1059 - protein, 12 aa, Artificial Sequence
  Description of Artificial Sequence: chemically synthesized sequence
SASSSVSSSYLY

SEQ ID NO: 1060 - protein, 7 aa, Artificial Sequence
  Description of Artificial Sequence: chemically synthesized sequence
NTSNLAS

SEQ ID NO: 1061 - protein, 9 aa, Artificial Sequence
  Description of Artificial Sequence: chemically synthesized sequence
HQWRSYPPT

SEQ ID NO: 1062 - protein, 5 aa, Artificial Sequence
  Description of Artificial Sequence: chemically synthesized sequence
SGYWN

SEQ ID NO: 1063 - protein, 16 aa, Artificial Sequence
  Description of Artificial Sequence: chemically synthesized sequence
YISYSGSTYYNPSLKS

SEQ ID NO: 1064 - protein, 11 aa, Artificial Sequence
  Description of Artificial Sequence: chemically synthesized sequence
SLLWFSTGFAY

SEQ ID NO: 1065 - protein, 10 aa, Artificial Sequence
  Description of Artificial Sequence: chemically synthesized sequence
SANSSVSYMH

SEQ ID NO: 1066 - protein, 7 aa, Artificial Sequence
  Description of Artificial Sequence: chemically synthesized sequence
DTSKLAS

SEQ ID NO: 1067 - protein, 9 aa, Artificial Sequence
  Description of Artificial Sequence: chemically synthesized sequence
QQWSSNPWT

SEQ ID NO: 1068 - protein, 16 aa, Artificial Sequence
  Description of Artificial Sequence: chemically synthesized sequence
YIWSGGITDYNAAFKS

SEQ ID NO: 1069 - protein, 15 aa, Artificial Sequence
  Description of Artificial Sequence: chemically synthesized sequence
RASQSVSTSSYSYMH

SEQ ID NO: 1070 - protein, 9 aa, Artificial Sequence
  Description of Artificial Sequence: chemically synthesized sequence
QNSWEIPYT

SEQ ID NO: 1071 - protein, 5 aa, Artificial Sequence
  Description of Artificial Sequence: chemically synthesized sequence
STGMS

SEQ ID NO: 1072 - protein, 16 aa, Artificial Sequence
  Description of Artificial Sequence: chemically synthesized sequence
SISSGGTTYYLGSVQG

SEQ ID NO: 1073 - protein, 8 aa, Artificial Sequence
  Description of Artificial Sequence: chemically synthesized sequence
GYDAGFAY

SEQ ID NO: 1074 - protein, 17 aa, Artificial Sequence
  Description of Artificial Sequence: chemically synthesized sequence
KSSQSLLYSSNQKNSLA

SEQ ID NO: 1075 - protein, 7 aa, Artificial Sequence
  Description of Artificial Sequence: chemically synthesized sequence
WASNRES

SEQ ID NO: 1076 - protein, 9 aa, Artificial Sequence
  Description of Artificial Sequence: chemically synthesized sequence
QQYYSYPLT

SEQ ID NO: 1077 - protein, 5 aa, Artificial Sequence
  Description of Artificial Sequence: chemically synthesized sequence
SGYWT

SEQ ID NO: 1078 - protein, 15 aa, Artificial Sequence
  Description of Artificial Sequence: chemically synthesized sequence
YIYTGSTYYNPSLKS

SEQ ID NO: 1079 - protein, 9 aa, Artificial Sequence
  Description of Artificial Sequence: chemically synthesized sequence
QRDWLGFAY

SEQ ID NO: 1080 - protein, 15 aa, Artificial Sequence
  Description of Artificial Sequence: chemically synthesized sequence
RASQSVSTSSYSYVH

SEQ ID NO: 1081 - protein, 16 aa, Artificial Sequence
  Description of Artificial Sequence: chemically synthesized sequence
SISSGGSIYYPDSVKG

SEQ ID NO: 1082 - protein, 8 aa, Artificial Sequence
  Description of Artificial Sequence: chemically synthesized sequence
GYDAGFAF

SEQ ID NO: 1083 - protein, 10 aa, Artificial Sequence
  Description of Artificial Sequence: chemically synthesized sequence
GFTFSMYMMM

SEQ ID NO: 1084 - protein, 10 aa, Artificial Sequence
  Description of Artificial Sequence: chemically synthesized sequence
GFTFSAYAMA

SEQ ID NO: 1085 - protein, 10 aa, Artificial Sequence
  Description of Artificial Sequence: chemically synthesized sequence
GFTFSAYRMF

SEQ ID NO: 1086 - protein, 10 aa, Artificial Sequence
  Description of Artificial Sequence: chemically synthesized sequence
GFTFSAYLMV

SEQ ID NO: 1087 - protein, 10 aa, Artificial Sequence
  Description of Artificial Sequence: chemically synthesized sequence
GFTFSAYVMF

SEQ ID NO: 1088 - protein, 10 aa, Artificial Sequence
  Description of Artificial Sequence: chemically synthesized sequence
GFTFSAYVMS

SEQ ID NO: 1089 - protein, 10 aa, Artificial Sequence
  Description of Artificial Sequence: chemically synthesized sequence
GFTFSGYLMV

SEQ ID NO: 1090 - protein, 10 aa, Artificial Sequence
  Description of Artificial Sequence: chemically synthesized sequence
GFTFSGYQML

SEQ ID NO: 1091 - protein, 10 aa, Artificial Sequence
  Description of Artificial Sequence: chemically synthesized sequence
GFTFSGYSMF

SEQ ID NO: 1092 - protein, 10 aa, Artificial Sequence
  Description of Artificial Sequence: chemically synthesized sequence
GFTFSGYWMA

SEQ ID NO: 1093 - protein, 10 aa, Artificial Sequence
  Description of Artificial Sequence: chemically synthesized sequence
GFTFSQYLMY

SEQ ID NO: 1094 - protein, 10 aa, Artificial Sequence
  Description of Artificial Sequence: chemically synthesized sequence
GFTFSQYVMF

SEQ ID NO: 1095 - protein, 10 aa, Artificial Sequence
  Description of Artificial Sequence: chemically synthesized sequence
GFTFSQYYMY

SEQ ID NO: 1096 - protein, 10 aa, Artificial Sequence
  Description of Artificial Sequence: chemically synthesized sequence
GFTFSSYLMS

SEQ ID NO: 1097 - protein, 10 aa, Artificial Sequence
  Description of Artificial Sequence: chemically synthesized sequence
GFTFSSYLMT

SEQ ID NO: 1098 - protein, 10 aa, Artificial Sequence
  Description of Artificial Sequence: chemically synthesized sequence
GFTFSSYQMV

SEQ ID NO: 1099 - protein, 10 aa, Artificial Sequence
  Description of Artificial Sequence: chemically synthesized sequence
GFTFSSYSMA

SEQ ID NO: 1100 - protein, 10 aa, Artificial Sequence
  Description of Artificial Sequence: chemically synthesized sequence
GFTFSSYVMF

SEQ ID NO: 1101 - protein, 10 aa, Artificial Sequence
  Description of Artificial Sequence: chemically synthesized sequence
GFTFSSYVMS

SEQ ID NO: 1102 - protein, 10 aa, Artificial Sequence
  Description of Artificial Sequence: chemically synthesized sequence
GFTFSSYVMY

SEQ ID NO: 1103 - protein, 10 aa, Artificial Sequence
  Description of Artificial Sequence: chemically synthesized sequence
GFTFSSYYMF

SEQ ID NO: 1104 - protein, 10 aa, Artificial Sequence
  Description of Artificial Sequence: chemically synthesized sequence
GFTFSSYYMV

SEQ ID NO: 1105 - protein, 10 aa, Artificial Sequence
  Description of Artificial Sequence: chemically synthesized sequence
GFTFSYYSMV

SEQ ID NO: 1106 - protein, 10 aa, Artificial Sequence
  Description of Artificial Sequence: chemically synthesized sequence
GFTFSWYLMA

SEQ ID NO: 1107 - protein, 10 aa, Artificial Sequence
  Description of Artificial Sequence: chemically synthesized sequence
GFTFSWYQMS

SEQ ID NO: 1108 - protein, 115 aa, Artificial Sequence
  Description of Artificial Sequence: chemically synthesized sequence
QSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSS

SEQ ID NO: 1109 - protein, 112 aa, Artificial Sequence
  Description of Artificial Sequence: chemically synthesized sequence
AIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVR

SEQ ID NO: 1110 - protein, 121 aa, Artificial Sequence
  Description of Artificial Sequence: chemically synthesized sequence
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNIVATITPLDYWGQGTLVTVSS

SEQ ID NO: 1111 - protein, 110 aa, Artificial Sequence
  Description of Artificial Sequence: chemically synthesized sequence
QPVLTQPPSVSAAPGQKVTISCSGSSSNIANNYVSWYQQLPGTAPKLLIFANNKRPSGIPDRFSGSKSGTSAALDITGLQTGDEADYYCGTWDSDLRAGVFGGGTKLTVL

SEQ ID NO: 1112 - protein, 123 aa, Artificial Sequence; identical to SEQ ID NO: 531
  Description of Artificial Sequence: chemically synthesized sequence

SEQ ID NO: 1113 - protein, 118 aa, Artificial Sequence; identical to SEQ ID NO: 540
  Description of Artificial Sequence: chemically synthesized sequence

SEQ ID NO: 1114 - protein, 118 aa, Artificial Sequence; identical to SEQ ID NO: 541
  Description of Artificial Sequence: chemically synthesized sequence

SEQ ID NO: 1115 - protein, 118 aa, Artificial Sequence; identical to SEQ ID NO: 540
  Description of Artificial Sequence: chemically synthesized sequence

SEQ ID NO: 1116 - protein, 118 aa, Artificial Sequence; identical to SEQ ID NO: 541
  Description of Artificial Sequence: chemically synthesized sequence

SEQ ID NO: 1117 - protein, 118 aa, Artificial Sequence; identical to SEQ ID NO: 541
  Description of Artificial Sequence: chemically synthesized sequence

SEQ ID NO: 1118 - protein, 118 aa, Artificial Sequence; identical to SEQ ID NO: 540
  Description of Artificial Sequence: chemically synthesized sequence

SEQ ID NO: 1119 - protein, 120 aa, Artificial Sequence; identical to SEQ ID NO: 539
  Description of Artificial Sequence: chemically synthesized sequence

SEQ ID NO: 1120 - protein, 118 aa, Artificial Sequence; identical to SEQ ID NO: 549
  Description of Artificial Sequence: chemically synthesized sequence

SEQ ID NO: 1121 - protein, 118 aa, Artificial Sequence; identical to SEQ ID NO: 550
  Description of Artificial Sequence: chemically synthesized sequence

SEQ ID NO: 1122 - protein, 121 aa, Artificial Sequence
  Description of Artificial Sequence: chemically synthesized sequence
QMQLVQSGAEVKKPGSSVKVSCKASGGTFSSYAYSWVRQAPGQGLEWMGGIIPSFGTANYAQKFQGRVTITADESTSTAYMELSSLRSEDTAVYYCARGPIVATITPLDYWGQGTLVTVSS

SEQ ID NO: 1123 - protein, 121 aa, Artificial Sequence
  Description of Artificial Sequence: chemically synthesized sequence
QMQLVQSGAEVKKPGSSVKVSCKASGGTFSSYAYSWVRQAPGQGLEWMGGIIPIFGTANYAQKFQGRVTITADESTSTAYMELSSLRSEDTAVYYCARGPIVATITPLDYWGQGTLVTVSS

SEQ ID NO: 1124 - protein, 121 aa, Artificial Sequence; identical to SEQ ID NO: 1122
  Description of Artificial Sequence: chemically synthesized sequence

SEQ ID NO: 1125 - protein, 121 aa, Artificial Sequence
  Description of Artificial Sequence: chemically synthesized sequence
QMQLVQSGAEVKKPGSSVKVSCKASGGTFSSYAISWVRQAPGQGLEWMGGIIPAFGTANYAQKFQGRVTITADESTSTAYMELSSLRSEDTAVYYCARGPIVATITPLDYWGQGTLVTVSS

SEQ ID NO: 1126 - protein, 108 aa, Artificial Sequence; identical to SEQ ID NO: 577
  Description of Artificial Sequence: chemically synthesized sequence

SEQ ID NO: 1127 - protein, 107 aa, Artificial Sequence
  Description of Artificial Sequence: chemically synthesized sequence
AIRMTQSPSSLSASVGDRVTITCRASQSISSYLNWYQQKPGKAPKLLIYTTSSLKSGVPSRFSGSGSGTDFTLTISRLQPEDFATYYCQQSYSSTWTFGRGTKVEIK

SEQ ID NO: 1128 - protein, 110 aa, Artificial Sequence; identical to SEQ ID NO: 551
  Description of Artificial Sequence: chemically synthesized sequence

SEQ ID NO: 1129 - protein, 110 aa, Artificial Sequence; identical to SEQ ID NO: 560
  Description of Artificial Sequence: chemically synthesized sequence

SEQ ID NO: 1130 - protein, 111 aa, Artificial Sequence; identical to SEQ ID NO: 561
  Description of Artificial Sequence: chemically synthesized sequence

SEQ ID NO: 1131 - protein, 110 aa, Artificial Sequence; identical to SEQ ID NO: 562
  Description of Artificial Sequence: chemically synthesized sequence

SEQ ID NO: 1132 - protein, 110 aa, Artificial Sequence; identical to SEQ ID NO: 563
  Description of Artificial Sequence: chemically synthesized sequence

SEQ ID NO: 1133 - protein, 110 aa, Artificial Sequence; identical to SEQ ID NO: 564
  Description of Artificial Sequence: chemically synthesized sequence

SEQ ID NO: 1134 - protein, 112 aa, Artificial Sequence; identical to SEQ ID NO: 565
  Description of Artificial Sequence: chemically synthesized sequence

SEQ ID NO: 1135 - protein, 110 aa, Artificial Sequence; identical to SEQ ID NO: 572
  Description of Artificial Sequence: chemically synthesized sequence

SEQ ID NO: 1136 - protein, 110 aa, Artificial Sequence; identical to SEQ ID NO: 574
  Description of Artificial Sequence: chemically synthesized sequence

SEQ ID NO: 1137 - protein, 112 aa, Artificial Sequence; identical to SEQ ID NO: 575
  Description of Artificial Sequence: chemically synthesized sequence

SEQ ID NO: 1138 - protein, 108 aa, Artificial Sequence; identical to SEQ ID NO: 576
  Description of Artificial Sequence: chemically synthesized sequence

SEQ ID NO: 1139 - protein, 108 aa, Artificial Sequence; identical to SEQ ID NO: 577
  Description of Artificial Sequence: chemically synthesized sequence

SEQ ID NO: 1140 - protein, 108 aa, Artificial Sequence; identical to SEQ ID NO: 577
  Description of Artificial Sequence: chemically synthesized sequence

SEQ ID NO: 1141 - protein, 108 aa, Artificial Sequence; identical to SEQ ID NO: 577
  Description of Artificial Sequence: chemically synthesized sequence

SEQ ID NO: 1142 - protein, 122 aa, Artificial Sequence
  Description of Artificial Sequence: chemically synthesized sequence
QVQLVQSGSEVKKSGSSVKVSCKTSGGTFSITNYAINWVRQAPGQGLEWMGGILPIFGAAKYAQKFQDRVTITADESTNTAYLELSSLTSEDTAMYYCARGKRWLQSDLQYWGQGTLVTVSS

SEQ ID NO: 1143 - protein, 110 aa, Artificial Sequence
  Description of Artificial Sequence: chemically synthesized sequence
QPVLTQPASVSGSPGQSITISCTGSSSDVGSYDLVSWYQQSPGKVPKLLIYEGVKRPSGVSNRFSGSKSGNTASLTISGLQAEDEADYYCSSYAGTRNFVFGGGTQLTVL

SEQ ID NO: 1144 - protein, 153 aa, Artificial Sequence
  Description of Artificial Sequence: chemically synthesized sequence
QGQSGSGIALCPSHFCQLPQTGGGSSGGSGGSGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1145 - protein, 147 aa, Artificial Sequence
  Description of Artificial Sequence: chemically synthesized sequence
GIALCPSHFCQLPQTGGGSSGGSGGSGGLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1146 - protein, 153 aa, Artificial Sequence
  Description of Artificial Sequence: chemically synthesized sequence
QGQSGSGIALCPSHFCQLPQTGGGSSGGSGGSGGLSGRSGNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1147 - protein, 147 aa, Artificial Sequence
  Description of Artificial Sequence: chemically synthesized sequence
GIALCPSHFCQLPQTGGGSSGGSGGSGGLSGRSGNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1148 - protein, 153 aa, Artificial Sequence
  Description of Artificial Sequence: chemically synthesized sequence
QGQSGSGIALCPSHFCQLPQTGGGSSGGSGGSGGISSGLLSSGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1149 - protein, 147 aa, Artificial Sequence
  Description of Artificial Sequence: chemically synthesized sequence
GIALCPSHFCQLPQTGGGSSGGSGGSGGISSGLLSSGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1150 - protein, 153 aa, Artificial Sequence
  Description of Artificial Sequence: chemically synthesized sequence
QGQSGSGIALCPSHFCQLPQTGGGSSGGSGGSGGQNQALRMAGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1151 - protein, 147 aa, Artificial Sequence
  Description of Artificial Sequence: chemically synthesized sequence
GIALCPSHFCQLPQTGGGSSGGSGGSGGQNQALRMAGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1152 - protein, 155 aa, Artificial Sequence
  Description of Artificial Sequence: chemically synthesized sequence
QGQSGSGIALCPSHFCQLPQTGGGSSGGSGGSGGVHMPLGFLGPGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1153 - protein, 149 aa, Artificial Sequence
  Description of Artificial Sequence: chemically synthesized sequence
GIALCPSHFCQLPQTGGGSSGGSGGSGGVHMPLGFLGPGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1154 - protein, 158 aa, Artificial Sequence
  Description of Artificial Sequence: chemically synthesized sequence
QGQSGSGIALCPSHFCQLPQTGGGSSGGSGGSGGISSGLLSGRSGNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1155 - protein, 152 aa, Artificial Sequence
  Description of Artificial Sequence: chemically synthesized sequence
GIALCPSHFCQLPQTGGGSSGGSGGSGGISSGLLSGRSGNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1156 - protein, 160 aa, Artificial Sequence
  Description of Artificial Sequence: chemically synthesized sequence
QGQSGSGIALCPSHFCQLPQTGGGSSGGSGGSGGISSGLLSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1157 - protein, 154 aa, Artificial Sequence
  Description of Artificial Sequence: chemically synthesized sequence
GIALCPSHFCQLPQTGGGSSGGSGGSGGISSGLLSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1158 - protein, 163 aa, Artificial Sequence
  Description of Artificial Sequence: chemically synthesized sequence
QGQSGSGIALCPSHFCQLPQTGGGSSGGSGGSGGAVGLLAPPTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1159 - protein, 157 aa, Artificial Sequence
  Description of Artificial Sequence: chemically synthesized sequence
GIALCPSHFCQLPQTGGGSSGGSGGSGGAVGLLAPPTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1160 - protein, 162 aa, Artificial Sequence
  Description of Artificial Sequence: chemically synthesized sequence
QGQSGSGIALCPSHFCQLPQTGGGSSGGSGGSGGAVGLLAPPSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1161 - protein, 156 aa, Artificial Sequence
  Description of Artificial Sequence: chemically synthesized sequence
GIALCPSHFCQLPQTGGGSSGGSGGSGGAVGLLAPPSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1162 - protein, 158 aa, Artificial Sequence
  Description of Artificial Sequence: chemically synthesized sequence
QGQSGSGIALCPSHFCQLPQTGGGSSGGSGGSGGISSGLLSGRSDDHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1163 - protein, 152 aa, Artificial Sequence
  Description of Artificial Sequence: chemically synthesized sequence
GIALCPSHFCQLPQTGGGSSGGSGGSGGISSGLLSGRSDDHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1164 - protein, 158 aa, Artificial Sequence
  Description of Artificial Sequence: chemically synthesized sequence
QGQSGSGIALCPSHFCQLPQTGGGSSGGSGGSGGISSGLLSGRSDIHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1165 - protein, 152 aa, Artificial Sequence
  Description of Artificial Sequence: chemically synthesized sequence
GIALCPSHFCQLPQTGGGSSGGSGGSGGISSGLLSGRSDIHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1166 - protein, 158 aa, Artificial Sequence
  Description of Artificial Sequence: chemically synthesized sequence
QGQSGSGIALCPSHFCQLPQTGGGSSGGSGGSGGISSGLLSGRSDQHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1167 - protein, 152 aa, Artificial Sequence
  Description of Artificial Sequence: chemically synthesized sequence
GIALCPSHFCQLPQTGGGSSGGSGGSGGISSGLLSGRSDQHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1168 - protein, 158 aa, Artificial Sequence
  Description of Artificial Sequence: chemically synthesized sequence
QGQSGSGIALCPSHFCQLPQTGGGSSGGSGGSGGISSGLLSGRSDTHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1169 - protein, 152 aa, Artificial Sequence
  Description of Artificial Sequence: chemically synthesized sequence
GIALCPSHFCQLPQTGGGSSGGSGGSGGISSGLLSGRSDTHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1170 - protein, 158 aa, Artificial Sequence
  Description of Artificial Sequence: chemically synthesized sequence
QGQSGSGIALCPSHFCQLPQTGGGSSGGSGGSGGISSGLLSGRSDYHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1171 - protein, 152 aa, Artificial Sequence
  Description of Artificial Sequence: chemically synthesized sequence
GIALCPSHFCQLPQTGGGSSGGSGGSGGISSGLLSGRSDYHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1172 - protein, 158 aa, Artificial Sequence
  Description of Artificial Sequence: chemically synthesized sequence
QGQSGSGIALCPSHFCQLPQTGGGSSGGSGGSGGISSGLLSGRSDNPGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1173 - protein, 152 aa, Artificial Sequence
  Description of Artificial Sequence: chemically synthesized sequence
GIALCPSHFCQLPQTGGGSSGGSGGSGGISSGLLSGRSDNPGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1174 - protein, 158 aa, Artificial Sequence
  Description of Artificial Sequence: chemically synthesized sequence
QGQSGSGIALCPSHFCQLPQTGGGSSGGSGGSGGISSGLLSGRSANPGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1175 - protein, 152 aa, Artificial Sequence
  Description of Artificial Sequence: chemically synthesized sequence
GIALCPSHFCQLPQTGGGSSGGSGGSGGISSGLLSGRSANPGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1176 - protein, 158 aa, Artificial Sequence
  Description of Artificial Sequence: chemically synthesized sequence
QGQSGSGIALCPSHFCQLPQTGGGSSGGSGGSGGISSGLLSGRSANIGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1177 - protein, 152 aa, Artificial Sequence
  Description of Artificial Sequence: chemically synthesized sequence
GIALCPSHFCQLPQTGGGSSGGSGGSGGISSGLLSGRSANIGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1178 - protein, 158 aa, Artificial Sequence
  Description of Artificial Sequence: chemically synthesized sequence
QGQSGSGIALCPSHFCQLPQTGGGSSGGSGGSGGISSGLLSGRSDNIGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1179 - protein, 152 aa, Artificial Sequence
  Description of Artificial Sequence: chemically synthesized sequence
GIALCPSHFCQLPQTGGGSSGGSGGSGGISSGLLSGRSDNIGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1180 - protein, 167 aa, Artificial Sequence
  Description of Artificial Sequence: chemically synthesized sequence
QGQSGSGIALCPSHFCQLPQTGGGSSGGSGGSGGAVGLLAPPGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1181 - protein, 161 aa, Artificial Sequence
  Description of Artificial Sequence: chemically synthesized sequence
GIALCPSHFCQLPQTGGGSSGGSGGSGGAVGLLAPPGGTSTSGRSANPRGGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1182 - protein, 158 aa, Artificial Sequence
  Description of Artificial Sequence: chemically synthesized sequence
QGQSGSIACRHFMEQLPFCHHGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1183 - protein, 152 aa, Artificial Sequence
  Description of Artificial Sequence: chemically synthesized sequence
IACRHFMEQLPFCHHGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1184 - protein, 158 aa, Artificial Sequence
  Description of Artificial Sequence: chemically synthesized sequence
QGQSGSPCYWHPFFAYRYCNTGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1185 - protein, 152 aa, Artificial Sequence
  Description of Artificial Sequence: chemically synthesized sequence
PCYWHPFFAYRYCNTGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1186 - protein, 158 aa, Artificial Sequence
  Description of Artificial Sequence: chemically synthesized sequence
QGQSGSVCYYMDWLGRNWCSSGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1187 - protein, 152 aa, Artificial Sequence
  Description of Artificial Sequence: chemically synthesized sequence
VCYYMDWLGRNWCSSGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1188 - protein, 158 aa, Artificial Sequence
  Description of Artificial Sequence: chemically synthesized sequence
QGQSGSPCHPHPADARPYCNVGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1189 - protein, 152 aa, Artificial Sequence
  Description of Artificial Sequence: chemically synthesized sequence
PCHPHPADARPYCNVGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1190 - protein, 158 aa, Artificial Sequence
  Description of Artificial Sequence: chemically synthesized sequence
QGQSGSPCHPHPYAARPYCNVGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1191 - protein, 152 aa, Artificial Sequence
  Description of Artificial Sequence: chemically synthesized sequence
PCHPHPYAARPYCNVGGGSSGGSGGSGGISSGLLSGRSDNHGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1192 - protein, 5 aa, Artificial Sequence
  Description of Artificial Sequence: chemically synthesized sequence
GQSGS

SEQ ID NO: 1193 - protein, 4 aa, Artificial Sequence
  Description of Artificial Sequence: chemically synthesized sequence
QSGS

SEQ ID NO: 1194 - protein, 3 aa, Artificial Sequence
  Description of Artificial Sequence: chemically synthesized sequence
SGS

SEQ ID NO: 1195 - protein, 2 aa, Artificial Sequence
  Description of Artificial Sequence: chemically synthesized sequence
GS

SEQ ID NO: 1196 - protein, 6 aa, Artificial Sequence
  Description of Artificial Sequence: chemically synthesized sequence
QGQSGQ

SEQ ID NO: 1197 - protein, 5 aa, Artificial Sequence
  Description of Artificial Sequence: chemically synthesized sequence
GQSGQ

SEQ ID NO: 1198 - protein, 4 aa, Artificial Sequence
  Description of Artificial Sequence: chemically synthesized sequence
QSGQ

SEQ ID NO: 1199 - protein, 2 aa, Artificial Sequence
  Description of Artificial Sequence: chemically synthesized sequence
GQ

SEQ ID NO: 1200 - protein, 153 aa, Artificial Sequence
  Description of Artificial Sequence: chemically synthesized sequence
QGQSGSGIALCPSHFCQLPQTGGGSSGGSGGSGGAVGLLAPPGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1201 - protein, 147 aa, Artificial Sequence
  Description of Artificial Sequence: chemically synthesized sequence
GIALCPSHFCQLPQTGGGSSGGSGGSGGAVGLLAPPGGSDIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 1202 - protein, 445 aa, Artificial Sequence
  Description of Artificial Sequence: chemically synthesized sequence
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1203 - protein, 19 aa, Artificial Sequence
  Description of Artificial Sequence: chemically synthesized sequence
SSAGNNKNNKNNKNNKFDY

SEQ ID NO: 1204 - protein, 6 aa, Artificial Sequence
  Description of Artificial Sequence: Synthetic 6xHis tag
HHHHHH

What is claimed:

1. An isolated nucleic acid molecule encoding an antibody or an antigen binding fragment thereof (AB) comprising:

(a) a heavy chain variable region (VH) comprising:

(i) a variable heavy chain complementarity determining region 1 (VH CDR1) comprising the amino acid sequence of SEQ ID NO: 212;

(ii) a variable heavy chain complementarity determining region 2 (VH CDR2) comprising the amino acid sequence of SEQ ID NO: 246; and (iii) a variable heavy chain complementarity determining region 3 (VH CDR3) comprising the amino acid sequence of SEQ ID NO: 235; and (b) a light chain variable region (VL) comprising:

(i) a variable light chain complementarity region 1 (VL CDR1) comprising the amino acid sequence of SEQ ID NO: 209;

(ii) a variable light chain complementarity region 2 (VL CDR2) comprising the amino acid sequence of SEQ ID NO: 215 or 227; and (iii) a variable light chain complementarity region 3 (VL CDR3) comprising the amino acid sequence of SEQ ID NO: 228;
wherein the AB specifically binds mammalian PDL1.

2. The isolated nucleic acid of claim 1, wherein the mammalian PDL1 is selected from the group consisting of: a human PDL1, a murine PDL1, a rat PDL1, and a cynomolgus monkey PDL1.

3. The isolated nucleic acid of claim 1, wherein the AB has one or more of the following characteristics selected from the group consisting of:
   (a) the AB specifically binds to human PDL1, murine PDL1 or cynomolgus monkey PDL1 with a dissociation constant of less than 1 nM;
   (b) the AB specifically binds to human PDL1 and murine PDL1;
   (c) the AB specifically binds to human PDL1 and cynomolgus monkey PDL1;
   (d) the AB specifically binds to human PDL1, murine PDL1, and cynomolgus monkey PDL1;
   (e) the AB inhibits binding of human B7-1 and human PD1 to human PDL1;
   (f) the AB inhibits binding of murine B7-1 and murine PD1 to murine PDL1; and
   (g) the AB inhibits binding of cynomolgus monkey B7-1 and cynomolgus monkey PD1 to cynomolgus monkey PDL1.

4. The isolated nucleic acid of claim 1, wherein the AB blocks the ability of a natural ligand to bind to the mammalian PDL1 with an $EC_{50}$ of
   0.5 nM to 10 nM, 0.5 nM to 5 nM, 0.5 nM to 3 nM, 0.5 nM to 2 nM, 0.5 nM to 1 nM,
   1 nM to 10 nM, 1 nM to 5 nM, 1 nM to 3 nM, 1 nM to 2 nM,
   2 nM to 10 nM, 2 nM to 5 nM, 2 nM to 3 nM,
   3 nM to 10 nM, 3 nM to 5 nM, or
   5 nM to 10 nM.

5. The isolated nucleic acid of claim 4, wherein the natural ligand is a mammalian PD1.

6. The isolated nucleic acid of claim 4, wherein the natural ligand is selected from the group consisting of: a human PD1, a murine PD1, and a cynomolgus monkey PD1.

7. The isolated nucleic acid of claim 4, wherein the natural ligand is a mammalian B7-1.

8. The isolated nucleic acid of claim 4, wherein the natural ligand is selected from the group consisting of: a human B7-1, a murine B7-1, and a cynomolgus monkey B7-1.

9. The isolated nucleic acid of claim 1, wherein the VL CDR2 comprises the amino acid sequence of SEQ ID NO: 215.

10. An isolated nucleic acid molecule encoding an activatable antibody comprising:
    (a) an antibody or antigen binding fragment thereof (AB) that specifically binds to mammalian PDL1, wherein the AB comprises:
       (i) a heavy chain variable region (VH) comprising:
          a variable heavy chain complementarity determining region 1 (VH CDR1) comprising the amino acid sequence of SEQ ID NO: 212;
          a variable heavy chain complementarity determining region 2 (VH CDR2) comprising the amino acid sequence of SEQ ID NO: 246; and
          a variable heavy chain complementarity determining region 3 (VH CDR3) comprising the amino acid sequence of SEQ ID NO: 235; and
       (ii) a light chain variable region (VL) comprising:
          a light chain variable complementarity region 1 (VL CDR1) comprising the amino acid sequence of SEQ ID NO: 209;
          a light chain variable complementarity region 2 (VL CDR2) comprising the amino acid sequence of SEQ ID NO: 215 or 227; and
          a light chain variable complementarity region 3 (VL CDR3) comprising the amino acid sequence of SEQ ID NO: 228; and
    (b) a masking moiety (MM) comprising the amino acid sequence of SEQ ID NO: 63; and
    (c) a cleavable moiety (CM) comprising the amino acid sequence of SEQ ID NO: 377.

11. The isolated nucleic acid of claim 10, wherein the mammalian PDL1 is selected from the group consisting of: a human PDL1, a murine PDL1, a rat PDL1, and a cynomolgus monkey PDL1.

12. The isolated nucleic acid of claim 10, wherein the AB has one or more of the following characteristics selected from the group consisting of:
   (a) the AB specifically binds to human PDL1, murine PDL1 or cynomolgus monkey PDL1 with a dissociation constant of less than 1 nM;
   (b) the AB specifically binds to human PDL1 and murine PDL1;
   (c) the AB specifically binds to human PDL1 and cynomolgus monkey PDL1;
   (d) the AB specifically binds to human PDL1, murine PDL1 and cynomolgus monkey PDL1;
   (e) the AB inhibits binding of human B7-1 and human PD1 to human PDL1;
   (f) the AB inhibits binding of murine B7-1 and murine PD1 to murine PDL1; and
   (g) the AB inhibits binding of cynomolgus monkey B7-1 and cynomolgus monkey PD1 to cynomolgus monkey PDL1.

13. The isolated nucleic acid of claim 10, wherein the AB blocks the ability of a natural ligand to bind to the mammalian PDL1 with an $EC_{50}$ of
   0.5 nM to 10 nM, 0.5 nM to 5 nM, 0.5 nM to 3 nM, 0.5 nM to 2 nM, 0.5 nM to 1 nM,
   1 nM to 10 nM, 1 nM to 5 nM, 1 nM to 3 nM, 1 nM to 2 nM,
   2 nM to 10 nM, 2 nM to 5 nM, 2 nM to 3 nM,
   3 nM to 10 nM, 3 nM to 5 nM, or
   5 nM to 10 nM.

14. The isolated nucleic acid of claim 13, wherein the natural ligand is a mammalian PD1.

15. The isolated nucleic acid of claim 14, wherein the natural ligand is selected from the group consisting of: a human PD1, a murine PD1, and a cynomolgus monkey PD1.

16. The isolated nucleic acid of claim 13, wherein the natural ligand is a mammalian B7-1.

17. The isolated nucleic acid of claim 16, wherein the natural ligand is selected from the group consisting of: a human B7-1, a murine B7-1, and a cynomolgus monkey B7-1.

18. The isolated nucleic acid of claim 10, wherein the MM has a dissociation constant for binding to the AB that is greater than the dissociation constant of the AB to PDL1.

19. The isolated nucleic acid of claim 10, wherein the MM does not interfere or compete with the AB for binding to PDL1 when the activatable antibody is in a cleaved state.

20. The isolated nucleic acid of claim 10, wherein the MM is a polypeptide of no more than 40 amino acids in length.

21. The isolated nucleic acid of claim 10, wherein the MM polypeptide sequence is different from that of human PDL1.

22. The isolated nucleic acid of claim 10, wherein the MM polypeptide sequence is no more than 50% identical to any natural binding partner of the AB.

23. The isolated nucleic acid of claim 10, wherein the MM polypeptide sequence is no more than 25% identical to any natural binding partner of the AB.

24. The isolated nucleic acid of claim 10, wherein the CM is a substrate for a protease that is active in diseased tissue.

25. The isolated nucleic acid of claim 10, wherein the AB is linked to the CM.

26. The isolated nucleic acid of claim 25, wherein the AB is linked directly to the CM.

27. The isolated nucleic acid of claim 25, wherein the AB is linked to the CM via a linking peptide.

28. The isolated nucleic acid of claim 10, wherein the MM is linked to the CM such that the activatable antibody in an uncleaved state comprises the structural arrangement from N-terminus to C-terminus as follows: MM-CM-AB or AB-CM-MM.

29. The isolated nucleic acid of claim 28, wherein the activatable antibody comprises a linking peptide between the MM and the CM.

30. The isolated nucleic acid of claim 28, wherein the activatable antibody comprises a linking peptide between the CM and the AB.

31. The isolated nucleic acid of claim 28, wherein the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM.

32. The isolated nucleic acid of claim 31, wherein the two linking peptides need not be identical to each other.

33. The isolated nucleic acid of claim 31, wherein each of LP1 and LP2 is a peptide of about 1 to 20 amino acids in length.

34. The isolated nucleic acid of claim 10, wherein the VL CDR2 comprises the amino acid sequence of SEQ ID NO: 215.

35. The isolated nucleic acid of claim 10, wherein the AB comprises a VH comprising the amino acid sequence of SEQ ID NO: 46 and a VL comprising the amino acid sequence of SEQ ID NO: 12.

36. The isolated nucleic acid of claim 10, wherein the AB comprises a VH comprising the comprising the amino acid sequence of SEQ ID NO: 46 and a VL comprising the amino acid sequence of SEQ ID NO: 58.

37. The isolated nucleic acid of claim 10, wherein the activatable antibody comprises a VL comprising the amino acid sequence of SEQ ID NO: 137 and a VH comprising the amino acid sequence of SEQ ID NO: 46.

38. The isolated nucleic acid of claim 10, wherein the activatable antibody comprises a VL comprising the amino acid sequence of SEQ ID NO: 985 and a VH comprising the amino acid sequence of SEQ ID NO: 46.

39. The isolated nucleic acid of claim 10, wherein the activatable antibody comprises a VL comprising the amino acid sequence of SEQ ID NO: 428 and a VH comprising the amino acid sequence of SEQ ID NO: 432.

40. The isolated nucleic acid of claim 10, wherein the activatable antibody comprises a VL comprising the amino acid sequence of SEQ ID NO: 1008 and a VH comprising the amino acid sequence of SEQ ID NO: 432.

41. A vector comprising a nucleic acid molecule of claim 1.

42. A vector comprising a nucleic acid molecule of claim 10.

43. A method of producing an antibody by culturing a cell under conditions that lead to expression of the antibody, wherein the cell comprises the nucleic acid molecule encoding the antibody of claim 1.

44. A method of producing an activatable antibody by culturing a cell under conditions that lead to expression of the activatable antibody, wherein the cell comprises the nucleic acid molecule encoding the antibody of claim 10.

* * * * *

UNITED STATES PATENT AND TRADEMARK OFFICE
CERTIFICATE OF CORRECTION

PATENT NO. : 10,669,339 B2
APPLICATION NO. : 16/428767
DATED : June 2, 2020
INVENTOR(S) : James William West et al.

Page 1 of 1

It is certified that error appears in the above-identified patent and that said Letters Patent is hereby corrected as shown below:

In the Specification

Column 1, Approximately Line 8, after "2016," insert -- now U.S. Pat. No. 10,336,824, --.

Signed and Sealed this
Fourteenth Day of July, 2020

Andrei Iancu
*Director of the United States Patent and Trademark Office*